United States Patent
Akinc et al.

(10) Patent No.: US 12,553,053 B2
(45) Date of Patent: Feb. 17, 2026

(54) TRANSMEMBRANE SERINE PROTEASE 2 (TMPRSS2) iRNA COMPOSITIONS AND METHODS OF USE THEREOF

(71) Applicant: Alnylam Pharmaceuticals, Inc., Cambridge, MA (US)

(72) Inventors: Akin Akinc, Needham, MA (US); James D. McIninch, Burlington, MA (US); Yesseinia Anglero-Rodriguez, Cambridge, MA (US); Mark K. Schlegel, Boston, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 686 days.

(21) Appl. No.: 17/956,884

(22) Filed: Sep. 30, 2022

(65) Prior Publication Data

US 2023/0193284 A1    Jun. 22, 2023

Related U.S. Application Data

(63) Continuation of application No. PCT/US2021/024076, filed on Mar. 25, 2021.

(60) Provisional application No. 63/050,137, filed on Jul. 10, 2020, provisional application No. 63/006,364, filed on Apr. 7, 2020.

(51) Int. Cl.
   *C12N 15/113*    (2010.01)
   *C12N 15/10*    (2006.01)

(52) U.S. Cl.
   CPC ...... *C12N 15/1138* (2013.01); *C12N 15/1062* (2013.01); *C12Y 304/21* (2013.01); *C12N 2310/14* (2013.01); *C12N 2310/315* (2013.01); *C12N 2310/3515* (2013.01)

(58) Field of Classification Search
   CPC ............ C12N 15/1138; C12N 2310/14; C12N 2310/3515
   See application file for complete search history.

(56) References Cited

U.S. PATENT DOCUMENTS

| | | |
|---|---|---|
| 11,208,660 B1 | 12/2021 | Akinc et al. |
| 2022/0127615 A1 | 4/2022 | Akinc et al. |
| 2023/0133147 A1 | 5/2023 | Akinc et al. |
| 2023/0193284 A1 | 6/2023 | Akinc et al. |

FOREIGN PATENT DOCUMENTS

| | | |
|---|---|---|
| WO | WO-2004/094636 A1 | 11/2004 |
| WO | WO-2005023083 A2 | 3/2005 |
| WO | WO-2005/086804 A2 | 9/2005 |
| WO | WO-2006/021817 A2 | 3/2006 |
| WO | WO-2006/085987 A2 | 8/2006 |
| WO | WO-2010/039548 A2 | 4/2010 |
| WO | WO-2013/075035 A1 | 5/2013 |
| WO | WO-2014/005596 A1 | 1/2014 |
| WO | WO-2019/217459 A1 | 11/2019 |
| WO | WO-2020/069055 A1 | 4/2020 |
| WO | WO-2021/195307 A1 | 9/2021 |
| WO | WO-2021/206917 A1 | 10/2021 |
| WO | WO-2021/206922 A1 | 10/2021 |

OTHER PUBLICATIONS

Kawase et al., "Simultaneous Treatment 1-95 of Human Bronchial Epithelial Cells with Serine and Cysteine Protease Inhibitors Prevents Severe Acute Respiratory Syndrome Coronavirus Entry", J Virol. Jun. 2012; 86(12):6537-45.
Shen et al., "TMPRSS2: A potential target for treatment of influenza virus and coronavirus infections" Biochimie. Nov. 2017:142:1-10.
Hoffmann et al., "SARS-CoV-2 Cell Entry Depends on ACE2 and TMPRSS2 and Is Blocked by a Clinically Proven Protease Inhibitor" Cell. Apr. 16, 2020;181(2):271-280.e8.
Bertram et al., "TMPRSS2 and TMPRSS4 Facilitate Trypsin-Independent Spread of Influenza Virus in Caco-2 Cells" J Virol. Oct. 2010;84(19):10016-25.
Matsuyama et al., "Enhanced isolation of SARS-CoV-2 by TMPRSS2-expressing cells", Proceedings of the National Academy of Sciences, vol. 117, No. 13, Mar. 31, 2020.
Iwata-Yoshikawa et al., "TMPRSS2 Contributes to Virus Spread and Immunopathology in the Airways of Murine Models after Coronavirus Infection.", J Virol. Jan. 2019; 93(6):e01815-18.
Internationl Search Report and Written Opinion from PCT/US2021/024076, mailed Jul. 5, 2021.
Vickers et al., Efficient reduction of target RNAs by small interfering RNA and RNase H-dependent antisense agents. A comparative analysis. J Biol Chem. Feb. 28, 2003;278(9):7108-18.
Reynolds et al., Rational siRNA design for RNA interference. Nat Biotechnol. Mar. 2004;22(3):326-30.
Watts et al., "Gene silencing by siRNAs and antisense oligonucleotides in the laboratory and the clinic", J Pathol. Jan. 2012 ; 226(2): 365-379.
Akerstrom et al., "Inhibition of SARS-CoV replication cycle by small interference RNAs silencing specific SARS proteins, 7a/7b, 3a/3b and S, " Antiviral Research 73 (2007) 219-227.
He et al., "Development of interfering RNA agents to inhibit SARS-associated coronavirus infection and replication", Hong Kong Med J 2009;15(Suppl 4):S28-31.
Li et al., "Using siRNA in prophylactic and therapeutic regimens against SARS coronavirus in Rhesus macaque", Nature Medicine, 2005, vol. 11(9), pp. 944-951.
Tang et al., "Application of siRNA against SARS in the rhesus macaque model", Methods Mol Biol. 2008;442:139-58.
Wu et al., "Inhibition of SARS-CoV replication by siRNA", Antiviral Research 65 (2005) 45-48.

(Continued)

*Primary Examiner* — J. E. Angell
(74) *Attorney, Agent, or Firm* — McCarter & English, LLP; Maria Laccotripe Zacharakis; Deborah L. Nagle

(57) ABSTRACT

The present invention relates to RNAi agents, e.g., dsRNA agents, targeting the transmembrane serine protein 2 (TMPRSS2) gene. The invention also relates to methods of using such RNAi agents to inhibit expression of a TMPRSS2 gene and to methods of treating or preventing a TMPRSS2-associated disease, e.g., COVID-19, in a subject.

23 Claims, No Drawings

Specification includes a Sequence Listing.

(56) References Cited

OTHER PUBLICATIONS

Zhang et al., "Silencing SARS-CoV Spike protein expression in cultured cells by RNA interference", FEBS Letters 560 (2004) 141-146.

Fukushima et al., "Development of a Chimeric DNA-RNA Hammerhead Ribozyme Targeting SARS Virus", Intervirology 2009;52:92-99.

Zumla et al., "Coronaviruses—drug discovery and therapeutic options", Nat Rev Drug Discov. May 2016;15(5):327-47.

Rider et al., "Broad-Spectrum Antiviral Therapeutics", PLoS One Jul. 27, 2011 6(7): e22572.

Liu et al. "Research and Development on Therapeutic Agents and Vaccines for COVID-19 and Related Human Coronavirus Diseases", ACS Cent. Sci. 2020, 6, 3, 315-331.

Hodgson, "The pandemic pipeline", Nat Biotechnol. May 2020;38(5):523-532.

International Search Report and Written Opinion from PCT/US2021/024038, mailed Jul. 8, 2021.

Zhou et al., "Glycopeptide Antibiotics Potently Inhibit Cathepsin L in the Late Endosome/Lysosome and Block the Entry of Ebola Virus, Middle East Respiratory Syndrome Coronavirus (MERS-CoV), and Severe Acute Respiratory Syndrome Coronavirus (SARS-CoV)", J Biol Chem. Apr. 22, 2016;291(17):9218-32.

Lu et al., "siRNA silencing of angiotensin-converting enzyme 2 reduced severe acute respiratory syndrome-associated coronavirus replications in Vero E6 cells", Eur J Clin Microbiol Infect Dis. Aug. 2008;27(8):709-15.

Li et al., "Angiotensin converting enzyme-2 is protective but downregulated in human and experimental lung fibrosis", Am J Physiol Lung Cell Mol Physiol. Jul. 2008;295(1):L178-85.

International Search Report and Written Opinion from PCT/US2021/024047, mailed Ju 5, 2021.

Foster et al., "Advanced siRNA Designs Further Improve In Vivo Performance of GalNAc-siRNA Conjugates", Mol Ther. Mar. 7, 2018;26(3):708-717.

Ui-Tei et al., "Functional dissection of siRNA sequence by systematic DNA substitution: modified siRNA with a DNA seed arm is a powerful tool for mammalian gene silencing with significantly reduced off-target effect", Nucleic Acids Res. Apr. 2008;36(7):2136-51.

Chernikov et al., "Current Development of siRNA Bioconjugates: From Research to the Clinic", Front Pharmacol. Apr. 26, 2019;10:444.

Hu et al., "Therapeutic siRNA: state of the art", Signal Transduction and Targeted Therapy (2020) 5:101.

Nair et al., "Impact of enhanced metabolic stability on pharmacokinetics and pharmacodynamics of GalNAc-siRNA conjugates", Nucleic Acids Res.Nov. 2, 2017;45(19):10969-10977.

Shukla et al., "Exploring Chemical Modifications for siRNA Therapeutics: A Structural and Functional Outlook", ChemMedChem. Mar. 1, 2010;5(3):328-49.

TRANSMEMBRANE SERINE PROTEASE 2 (TMPRSS2) iRNA COMPOSITIONS AND METHODS OF USE THEREOF

RELATED APPLICATIONS

This application is a 35 § U.S.C. 111(a) continuation application which claims the benefit of priority to PCT/US2021/024076, filed on Mar. 25, 2021, which, in turn, claims the benefit of priority to U.S. Provisional Application No. 63/006,364, filed on Apr. 7, 2020, and U.S. Provisional Application No. 63/050,137, filed on Jul. 10, 2020. The entire contents of each of the foregoing applications are incorporated herein by reference.

SEQUENCE LISTING

The instant application contains a Sequence Listing which has been submitted electronically in XML file format and is hereby incorporated by reference in its entirety. Said XML copy, created on Nov. 2, 2022, is named 121301-12603_SL.xml and is 9,189,032 bytes in size.

BACKGROUND OF THE INVENTION

Coronaviruses (CoV) are a large family of viruses that cause diseases in mammals and birds. Coronaviruses constitute the subfamily Orthocoronavirinae, in the family Coronaviridae. They are enveloped viruses with a positive-sense single-stranded RNA genome and a nucleocapsid of helical symmetry. The genome size of coronaviruses ranges from approximately 27 to 34 kilobases. The name coronavirus is derived from the Latin corona, meaning "crown" or "halo", which refers to the characteristic appearance reminiscent of a crown or a solar corona around the virions (virus particles) when viewed under two-dimensional transmission electron microscopy, due to the surface covering in club-shaped protein spikes.

The first step of viral infection is viral entry into host cells. The spike (S) protein of coronaviruses facilitates viral entry into target cells. Entry depends on binding of the surface unit, S1, of the S protein to a cellular receptor, which facilitates viral attachment to the surface of target cells. In addition, viral entry into cells requires S protein priming by host cellular proteases, which entails S protein cleavage at the S1/S2 and the S2' site and allows fusion of viral and cellular membranes, a process driven by the S2 subunit. Previous studies have shown that SARS-CoV-S engages angiotensin-converting enzyme 2 (ACE2) as the entry receptor (Li W, et al., *Nature* 426, 450-454, 2003) and employs the cellular serine protease TMPRSS2 for S protein priming (Glowacka I., et al., *J. Virol.* 85, 4122-4134, 2011; Matsuyama S. et al., *J. Virol.* 84, 12658-12664, 2010; Shulla A., et al., *J. Virol.* 85, 873-882, 2011). The SARS-CoV-S/ACE2 interface has been elucidated at the atomic level, and the efficiency of ACE2 usage was found to be a key determinant of SARS-CoV transmissibility (Li F, et al., *Science* 309, 1864-1868, 2005; Li W. et al., *EMBO J.* 24, 1634-1643, 2005). It has been shown recently that host cell entry of SARS-CoV-2 also depends on the SARS-CoV receptor, ACE2 and that TMPRSS2 is also employed by SARS-CoV-2 for S protein priming (Hoffmann M. et al., *Cell* 181, 1-10, 2020).

Coronaviruses can cause illness ranging from the common cold to more severe diseases. For example, infections with the human coronavirus strains CoV-229E, CoV-OC43, CoV-NL63 and CoV-HKU1 usually result in mild, self-limiting upper respiratory tract infections, such as a common cold, e.g., runny nose, sneezing, headache, cough, sore throat or fever (Zumla A. et al., *Nature Reviews Drug Discovery* 15(5): 327-47, 2016; Cheng V. C., et al., *Clin. Microbial. Rev.* 20: 660-694, 2007; Chan J. F. et al., *Clin. Microbial. Rev.* 28: 465-522, 2015). Other infections may result in more severe diseases such as Middle East Respiratory Syndrome (MERS-CoV) and Severe Acute Respiratory Syndrome (SARS-CoV), diseases associated with pneumonia, severe acute respiratory syndrome, kidney failure and death.

MERS-CoV and SARS-CoV have received global attention over the past decades owing to their ability to cause community and health-care-associated outbreaks of severe infections in human populations. MERS-CoV is a viral respiratory disease that was first reported in Saudi Arabia in 2012 and has since spread to more than 27 other countries, according to the World Health Organization (de Groot, R. J. et al., *J. Virol.* 87: 7790-7792, 2013). SARS was first reported in Asia in 2003, and quickly spread to about two dozen countries before being contained after about four months (Lee N. et al., *N. Engl. J. Med.* 348: 1986-1994, 2003; Peiris J. S. et al., *Lancet* 36: 1319-1325, 2003). Detailed investigations found that SARS-CoV was transmitted from civet cats to humans and MERS-CoV from dromedary camels to humans (Cheng V. C., et al., *Clin. Microbial. Rev.* 20: 660-694, 2007; Chan J. F. et al., *Clin. Microbial. Rev.* 28: 465-522, 2015).

A recent outbreak of respiratory disease caused by a novel coronavirus, severe acute respiratory syndrome coronavirus 2 (SARS-CoV-2), was first identified in Wuhan City, China. This disease, named by the World Health Organization as coronavirus disease 2019 ("COVID-19"), presents a major threat to public health worldwide. As of Mar. 26, 2020, there were more than 529,000 confirmed cases and 23,000 deaths across the world.

Coronaviruses pose major challenges to clinical management because many questions regarding transmission and control remain unanswered. Moreover, there is currently no vaccine to prevent infections by coronavirus, and there are no specific antiviral treatments available or proven to be effective to treat or prevent coronavirus infection in subjects. Given the critical role that TMPRSS2 plays in the first step of viral infection, TMPRSS2 constitutes a target for antiviral treatment.

Accordingly, there exists an immediate need for an agent that can selectively and efficiently silence the TMPRSS2 gene using the cell's own RNAi machinery that has both high biological activity and in vivo stability, and that can effectively inhibit expression of a target TMPSS2 gene.

BRIEF SUMMARY OF THE INVENTION

The present disclosure provides RNAi agent compositions which effect the RNA-induced silencing complex (RISC)-mediated cleavage of RNA transcripts of a gene encoding Transmembrane Serine Protease 2 (TMPRSS2). The TMPRSS2 gene may be within a cell, e.g., a cell within a subject, such as a human. The present disclosure also provides methods of using the RNAi agent compositions of the disclosure for inhibiting the expression of a TMPRSS2 gene or for treating a subject who would benefit from inhibiting or reducing the expression of a TMPRSS2 gene, e.g., a subject having a TMPRSS2-associated disorder, e.g., a subject having a coronavirus infection, e.g., a subject having Severe Acute Respiratory Syndrome 2 (SARS-CoV-2; COVID-19), Severe Acute Respiratory Syndrome (SARS-CoV), or Middle East Respiratory Syndrome (MERS-CoV), or a subject at risk of developing a coronavirus infection, e.g., during an epidemic or pandemic.

Accordingly, in one aspect, the instant disclosure provides a double stranded ribonucleic acid (dsRNA) agent for inhibiting expression of a Transmembrane Serine Protease 2 (TMPRSS2) gene, wherein the dsRNA agent comprises a sense strand and an antisense strand forming a double stranded region, wherein the sense strand comprises a nucleotide sequence comprising at least 15 contiguous nucleotides, with 0, 1, 2, or 3 mismatches, of a portion of the nucleotide sequence of SEQ ID NO:1, or a nucleotide sequence having at least 90% nucleotide sequence identity to a portion of the nucleotide sequence of SEQ ID NO:1, and the antisense strand comprises a nucleotide sequence comprising at least 15 contiguous nucleotides, with 0, 1, 2, or 3 mismatches, of the corresponding portion of the nucleotide sequence of SEQ ID NO:6, or a nucleotide sequence having at least 90% nucleotide sequence identity to a portion of the nucleotide sequence of SEQ ID NO:6; and wherein the sense strand or the antisense strand is conjugated to one or more lipophilic moieties.

In one aspect, the present invention provides a double stranded ribonucleic acid (dsRNA) agent for inhibiting expression of a TMPRSS2 gene in a cell, comprising a sense strand and an antisense strand forming a double stranded region, wherein the antisense strand comprises a region complementary to part of an mRNA encoding a TMPRSS2 gene (SEQ ID NO:1), wherein each strand independently is 14 to 30 nucleotides in length; and wherein the sense strand or the antisense strand is conjugated to one or more lipophilic moieties.

In yet another aspect, the present invention provides a double stranded RNAi agent for inhibiting expression of a TMPRSS2 gene in a cell, comprising a sense strand and an antisense strand forming a double stranded region, wherein the antisense strand comprises at least 15 contiguous nucleotides differing by no more than 3 nucleotides from any one of the antisense nucleotide sequences in any one of Tables 2-3, wherein each strand independently is 14 to 30 nucleotides in length; and wherein the sense strand or the antisense strand is conjugated to one or more lipophilic moieties.

In one embodiment, the sense strand or the antisense strand is a sense strand or an antisense strand selected from the group consisting of any of the sense strands and antisense strands in any one of Table 2-3.

In one embodiment, both the sense strand and the antisense strand is conjugated to one or more lipophilic moieties.

In one embodiment, the lipophilic moiety is conjugated to one or more positions in the double stranded region of the dsRNA agent.

In one embodiment, the lipophilic moiety is conjugated via a linker or a carrier.

In one embodiment, lipophilicity of the lipophilic moiety, measured by log Kow, exceeds 0.

In one embodiment, the hydrophobicity of the double-stranded RNAi agent, measured by the unbound fraction in a plasma protein binding assay of the double-stranded RNAi agent, exceeds 0.2.

In one embodiment, the plasma protein binding assay is an electrophoretic mobility shift assay using human serum albumin protein.

In one embodiment, the dsRNA agent comprises at least one modified nucleotide.

In one embodiment, no more than five of the sense strand nucleotides and no more than five of the nucleotides of the antisense strand are unmodified nucleotides In another embodiment, all of the nucleotides of the sense strand and all of the nucleotides of the antisense strand comprise a modification.

In one embodiment, at least one of the modified nucleotides is selected from the group a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphonate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, a 2'-O hexadecyl nucleotide, a nucleotide comprising a 2'-phosphate, a cytidine-2'-phosphate nucleotide, a guanosine-2'-phosphate nucleotide, a 2'-O-hexadecyl-cytidine-3'-phosphate nucleotide, a 2'-O-hexadecyl-adenosine-3'-phosphate nucleotide, a 2'-O-hexadecyl-guanosine-3'-phosphate nucleotide, a 2'-O-hexadecyl-uridine-3'-phosphate nucleotide, a 5'-vinyl phosphonate (VP), a 2'-deoxyadenosine-3'-phosphate nucleotide, a 2'-deoxycytidine-3'-phosphate nucleotide, a 2'-deoxyguanosine-3'-phosphate nucleotide, a 2'-deoxythymidine-3'-phosphate nucleotide, a 2'-deoxyuridine nucleotide, and a terminal nucleotide linked to a cholesteryl derivative and a dodecanoic acid bisdecylamide group; and combinations thereof.

In another embodiment, modified nucleotide is selected from the group consisting of a 2'-deoxy-2'-fluoro modified nucleotide, a 2'-deoxy-modified nucleotide, 3'-terminal deoxy-thymine nucleotides (dT), a locked nucleotide, an abasic nucleotide, a 2'-amino-modified nucleotide, a 2'-alkyl-modified nucleotide, a morpholino nucleotide, a phosphoramidate, and a non-natural base comprising nucleotide.

In another embodiment, the modified nucleotide comprises a short sequence of 3'-terminal deoxy-thymine nucleotides (dT).

In yet another embodiment, the modifications on the nucleotides are 2'-O-methyl modifications, 2'-deoxy-modifications, 2'fluoro modifications, 5'-vinyl phosphonate (VP) modification, and 2'-O hexadecyl nucleotide modifications.

In one embodiment, the dsRNA agent further comprises at least one phosphorothioate internucleotide linkage.

In one embodiment, the dsRNA agent comprises 6-8 phosphorothioate internucleotide linkages.

In one embodiment, each strand is no more than 30 nucleotides in length.

In one embodiment, at least one strand comprises a 3' overhang of at least 1 nucleotide.

In another embodiment, at least one strand comprises a 3' overhang of at least 2 nucleotides.

The double stranded region may be 15-30 nucleotide pairs in length; 17-23 nucleotide pairs in length; 17-25 nucleotide pairs in length; 23-27 nucleotide pairs in length; 19-21 nucleotide pairs in length; or 21-23 nucleotide pairs in length.

Each strand of the dsRNA agent may be has 19-30 nucleotides in length; 19-23 nucleotides in length; or 21-23 nucleotides in length.

In one embodiment, one or more lipophilic moieties are conjugated to one or more internal positions on at least one strand.

In one embodiment, the one or more lipophilic moieties are conjugated to one or more internal positions on at least one strand via a linker or carrier.

In one embodiment, the internal positions include all positions except the terminal two positions from each end of the at least one strand.

In another embodiment, the internal positions include all positions except the terminal three positions from each end of the at least one strand.

In another embodiment, the internal positions exclude a cleavage site region of the sense strand.

In yet another embodiment, the internal positions include all positions except positions 9-12, counting from the 5'-end of the sense strand.

In one embodiment, the internal positions include all positions except positions 11-13, counting from the 3'-end of the sense strand.

In one embodiment, the internal positions exclude a cleavage site region of the antisense strand.

In one embodiment, the internal positions include all positions except positions 12-14, counting from the 5'-end of the antisense strand.

In one embodiment, the internal positions include all positions except positions 11-13 on the sense strand, counting from the 3'-end, and positions 12-14 on the antisense strand, counting from the 5'-end.

In one embodiment, the one or more lipophilic moieties are conjugated to one or more of the internal positions selected from the group consisting of positions 4-8 and 13-18 on the sense strand, and positions 6-10 and 15-18 on the antisense strand, counting from the 5' end of each strand.

In one embodiment, the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

In one embodiment, the positions in the double stranded region exclude a cleavage site region of the sense strand.

In one embodiment, the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand.

In one embodiment, the lipophilic moiety is conjugated to position 21, position 20, position 15, position 1, or position 7 of the sense strand.

In one embodiment, the lipophilic moiety is conjugated to position 21, position 20, or position 15 of the sense strand.

In one embodiment, the lipophilic moiety is conjugated to position 20 or position 15 of the sense strand.

In one embodiment, the lipophilic moiety is conjugated to position 16 of the antisense strand.

In one embodiment, the lipophilic moiety is an aliphatic, alicyclic, or polyalicyclic compound.

In one embodiment, the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.

In one embodiment, the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

In one embodiment, the lipophilic moiety contains a saturated or unsaturated C6-C18 hydrocarbon chain.

In one embodiment, the lipophilic moiety contains a saturated or unsaturated C16 hydrocarbon chain.

In one embodiment, the saturated or unsaturated C16 hydrocarbon chain is conjugated to position 6, counting from the 5'-end of the strand.

In one embodiment, the lipophilic moiety is conjugated via a carrier that replaces one or more nucleotide(s) in the internal position(s) or the double stranded region.

In one embodiment, the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

In one embodiment, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.

In one embodiment, the lipophilic moiety is conjugated to a nucleobase, sugar moiety, or internucleosidic linkage.

In one embodiment, the lipophilic moiety or a targeting ligand is conjugated via a bio-cleavable linker selected from the group consisting of DNA, RNA, disulfide, amide, functionalized monosaccharides or oligosaccharides of galactosamine, glucosamine, glucose, galactose, mannose, and combinations thereof.

In one embodiment, the 3' end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

In one embodiment, the dsRNA agent further comprises a targeting ligand that targets a liver tissue.

In one embodiment, the targeting ligand is a GalNAc conjugate.

In one embodiment, the dsRNA agent further comprises a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

In one embodiment, the dsRNA agent further comprises a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In one embodiment, the dsRNA agent further comprises a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In one embodiment, the dsRNA agent further comprises a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In one embodiment, the dsRNA agent further comprises a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In one embodiment, the dsRNA agent further comprises a phosphate or phosphate mimic at the 5'-end of the antisense strand.

In one embodiment, the phosphate mimic is a 5'-vinyl phosphonate (VP).

In one embodiment, the base pair at the 1 position of the 5'-end of the antisense strand of the duplex is an AU base pair.

In one embodiment, the sense strand has a total of 21 nucleotides and the antisense strand has a total of 23 nucleotides.

The present invention further provides cells, pharmaceutical compositions for inhibiting expression of a TMPRSS2 gene, and pharmaceutical composition comprising a lipid formulation comprising the dsRNA agent of the invention.

In one aspect, the present invention provides a method of inhibiting expression of a TMPRSS2 gene in a cell. The method includes contacting the cell with the dsRNA agent of the invention, or the pharmaceutical composition of the invention; and maintaining the cell produced in step (a) for a time sufficient to obtain degradation of the mRNA transcript of a TMPRSS2 gene, thereby inhibiting expression of the TMPRSS2 gene in the cell.

In one embodiment, the cell is within a subject.

In one embodiment, the subject is a human.

In one embodiment, the expression of the TMPRSS2 gene is inhibited by at least 50%.

In one aspect, the present invention provides a method of inhibiting entry of a coronavirus into a cell. The method includes contacting the cell with the dsRNA agent of the invention, or the pharmaceutical composition of the invention; and maintaining the cell produced in step (a) for a time sufficient to obtain degradation of the mRNA transcript of the TMPRSS2 gene, thereby inhibiting entry of the coronavirus into the cell.

In one embodiment, the cell is within a subject.

In one embodiment, the subject is a human.

In one embodiment, the expression of the TMPRSS2 gene is inhibited by at least 50%.

In one aspect, the present invention provides a method of inhibiting replication of a coronavirus in a cell. The method includes contacting the cell with the dsRNA agent of the invention, or the pharmaceutical composition of the invention; and maintaining the cell produced in step (a) for a time sufficient to obtain degradation of the mRNA transcript of the TMPRSS2 gene, thereby inhibiting replication of the coronavirus in the cell.

In one embodiment, the cell is within a subject.

In one embodiment, the subject is a human.

In one embodiment, the expression of the TMPRSS2 gene is inhibited by at least 50%.

In another aspect, the present invention provides a method of inhibiting priming of a coronavirus S protein in a cell. The method includes contacting the cell with the dsRNA agent of the invention, or the pharmaceutical composition of the invention; and maintaining the cell produced in step (a) for a time sufficient to obtain degradation of an mRNA transcript of a TMPRSS2 gene, thereby inhibiting priming of a coronavirus S protein in the cell.

In one embodiment, the cell is within a subject.

In one embodiment, the subject is a human.

In one embodiment, the expression of the TMPRSS2 gene is inhibited by at least 50%.

In one aspect, the present invention provides a method of treating a TNPRSS2-associate disorder, e.g., a subject having a coronavirus infection or at risk of developing or at risk of having a coronavirus infection. The method includes administering to the subject a therapeutically effective amount of the dsRNA agent of the invention, or the pharmaceutical composition of the invention, thereby treating the subject.

In one embodiment, the subject is a human.

In one embodiment, the subject having the coronavirus infection is infected with a severe acute respiratory syndrome (SARS) virus, a Middle East respiratory syndrome (MERS) virus, or a severe acute respiratory syndrome 2 (SARS-2) virus.

In one embodiment, the subject at risk of developing a coronavirus infection, e.g., an infection caused by severe acute respiratory syndrome (SARS) virus, a Middle East respiratory syndrome (MERS) virus, or a severe acute respiratory syndrome 2 (SARS-2) virus, is a subject in an epidemic or pandemic.

In one embodiment, treating comprises amelioration of at least on sign or symptom of the disease.

In one embodiment, the dsRNA agent is administered to the subject at a dose of about 0.01 mg/kg to about 50 mg/kg.

In one embodiment, the administration of the dsRNA is pulmonary system administration.

In one embodiment, the pulmonary system administration is oral inhalation or intranasally.

In one embodiment, the method reduces the expression of an TMPRSS2 gene in a pulmonary system tissue, e.g., a nasopharynx tissue, an oropharynx tissue, a laryngopharynx tissue, a larynx tissue, a trachea tissue, a carina tissue, a bronchi tissue, a bronchiole tissue, or an alveoli tissue.

In one embodiment, the dsRNA agent is administered to the subject subcutaneously.

In one embodiment, the method further comprises administering to the subject an additional agent or a therapy suitable for treatment or prevention of a coronavirus-associated disorder.

In one embodiment, the additional therapeutic agent is selected from the group consisting of an antiviral agent, an immune stimulator, a therapeutic vaccine, a viral entry inhibitor, and a combination of any of the foregoing.

The present invention is further illustrated by the following detailed description.

DETAILED DESCRIPTION OF THE INVENTION

The present invention provides iRNA compositions which effect the RNA-induced silencing complex (RISC)-mediated cleavage of RNA transcripts of a TMPRSS2 gene. The TMPRSS2 gene may be within a cell, e.g., a cell within a subject, such as a human. The use of these iRNAs enables the targeted degradation of mRNAs of the corresponding gene (a TMPRSS2 gene) in mammals. The present disclosure also provides methods of using the RNAi compositions of the disclosure for inhibiting the expression of a TMPRSS2 gene for treating a subject having a disorder that would benefit from inhibiting or reducing the expression of a TMPRSS2 gene, e.g., a TMPRSS2-associated disorder, e.g., a coronavirus-associated disorder, e.g., a subject having a coronavirus infection, e.g., a subject having Severe Acute Respiratory Syndrome 2 (SARS-CoV-2; COVID-19), Severe Acute Respiratory Syndrome (SARS-CoV), or Middle East Respiratory Syndrome (MERS-CoV), or a subject at risk of a coronavirus infection, e.g., infection by Severe Acute Respiratory Syndrome 2 (SARS-CoV-2; COVID-19), Severe Acute Respiratory Syndrome (SARS-CoV), or Middle East Respiratory Syndrome (MERS-CoV), e.g., during an epidemic or pandemic The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a TMPRSS2 gene. In certain embodiments, the RNAi agents of the disclosure include an RNA strand (the antisense strand) having a region which is about 21-23 nucleotides in length, which region is substantially complementary to at least part of an mRNA transcript of a TMPRSS2 gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA of a TMPRSS2 gene. In some embodiments, such iRNA agents having longer length antisense strands preferably may include a second RNA strand (the sense strand) of 20-60 nucleotides in length wherein the sense and antisense strands form a duplex of 18-30 contiguous nucleotides.

The use of iRNAs of the invention enables the targeted degradation of the TMPRSS2 mRNAs in mammals Thus, methods and compositions including these iRNAs are useful for treating a subject having a TMPRSS2-associated disorder, e.g., a coronavirus-associated disorder, e.g., a subject having a coronavirus infection, e.g., a subject having Severe Acute Respiratory Syndrome 2 (SARS-CoV-2; COVID-19), Severe Acute Respiratory Syndrome (SARS-CoV), or Middle East Respiratory Syndrome (MERS-CoV) or treating a subject at risk of a TMPRSS2-associate disorder, e.g., a subject at risk of a coronavirus infection, e.g., infections resulting in Severe Acute Respiratory Syndrome 2 (SARS-CoV-2; COVID-19), Severe Acute Respiratory Syndrome (SARS-CoV), or Middle East Respiratory Syndrome (MERS-CoV), e.g., during an epidemic or pandemic.

In certain embodiments, the administration of the dsRNA to a subject results in an improvement in viral load, of lung function, or a stoppage or reduction of the rate of loss of lung function, reduction of fever, reduction of cough.

The following detailed description discloses how to make and use compositions containing iRNAs to inhibit the expression of a TMPRSS2 gene s as well as compositions, uses, and methods for treating subjects that would benefit from inhibition and/or reduction of the expression of a TMPRSS2 gene, e.g., subjects susceptible to or diagnosed with a TMPRSS2-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, the term "coronavirus," ("CoV"; subfamily Coronaviridae, family Coronaviridae, order Nidovirales), refers to a group of highly diverse, enveloped, positive-sense, single-stranded RNA viruses that cause respiratory, enteric, hepatic and neurological diseases of varying severity in a broad range of animal species, including humans. Coronaviruses are subdivided into four genera: Alphacoronavirus, Betacoronavirus (13CoV), Gammacoronavirus and Deltacoronavirus.

Any coronavirus that infects humans and animals is encompassed by the term "coronavirus" as used herein. Exemplary coronaviruses encompassed by the term include the coronaviruses that cause a common cold-like respiratory illness, e.g., human coronavirus 229E (HCoV-229E), human coronavirus NL63 (HCoV-NL63), human coronavirus OC43 (HCoV-OC43), and human coronavirus HKU1 (HCoV-HKU1); the coronavirus that causes avian infectious bronchitis virus (IBV); the coronavirus that causes murine hepatitis virus (MHV); the coronavirus that causes porcine transmissible gastroenteritis virus PRCoV; the coronavirus that causes porcine respiratory coronavirus and bovine coronavirus; the coronavirus that causes Severe Acute Respiratory Syndrome (SARS), the coronavirus that causes the Middle East respiratory syndrome (MERS), and the coronavirus that causes Severe Acute Respiratory Syndrome 2 (SARS-CoV-2; COVID-19).

The coronavirus (CoV) genome is a single-stranded, non-segmented RNA genome, which is approximately 26-32 kb. It contains 5'-methylated caps and 3'-polyadenylated tails and is arranged in the order of 5', replicase genes, genes encoding structural proteins (spike glycoprotein (S), envelope protein (E), membrane protein (M) and nucleocapsid protein (N)), polyadenylated tail and then the 3' end. The partially overlapping 5'-terminal open reading frame 1a/b (ORF1a/b) is within the 5' two-thirds of the CoV genome and encodes the large replicase polyprotein 1a (pp1a) and pp1ab. These polyproteins are cleaved by papain-like cysteine protease (PLpro) and 3C-like serine protease (3CLpro) to produce non-structural proteins, including RNA-dependent RNA polymerase (RdRp) and helicase (Hel), which are important enzymes involved in the transcription and replication of CoVs. The 3' one-third of the CoV genome encodes the structural proteins (S, E, M and N), which are essential for virus—cell-receptor binding and virion assembly, and other non-structural proteins and accessory proteins that may have immunomodulatory effects. (Peiris J S., et al., 2003, Nat. Med. 10 (Suppl. 12): 88-97).

As a coronavirus is a positive-sense, single-stranded RNA virus having a 5' methylated cap and a 3' polyadenylated tail, once the virus enters the cell and is uncoated, the viral RNA genome attaches to the host cell's ribosome for direct translation. The host ribosome translates the initial overlapping open reading frame of the virus genome and forms a long polyprotein. The polyprotein has its own proteases which cleave the polyprotein into multiple nonstructural proteins.

A number of the nonstructural proteins coalesce to form a multi-protein replicase-transcriptase complex (RTC). The main replicase-transcriptase protein is the RNA-dependent RNA polymerase (RdRp). It is directly involved in the replication and transcription of RNA from an RNA strand. The other nonstructural proteins in the complex assist in the replication and transcription process. The exoribonuclease non-structural protein for instance provides extra fidelity to replication by providing a proofreading function which the RNA-dependent RNA polymerase lacks.

One of the main functions of the complex is to replicate the viral genome. RdRp directly mediates the synthesis of negative-sense genomic RNA from the positive-sense genomic RNA. This is followed by the replication of positive-sense genomic RNA from the negative-sense genomic RNA. The other important function of the complex is to transcribe the viral genome. RdRp directly mediates the synthesis of negative-sense subgenomic RNA molecules from the positive-sense genomic RNA. This is followed by the transcription of these negative-sense subgenomic RNA molecules to their corresponding positive-sense mRNAs The replicated positive-sense genomic RNA becomes the genome of the progeny viruses.

As use herein, the term "severe acute respiratory syndrome coronavirus" or "SARS-CoV", refers to a coronavirus that was first discovered in 2003, which causes severe acute respiratory syndrome (SARS). SARS-CoV represents the prototype of a new lineage of coronaviruses capable of causing outbreaks of clinically significant and frequently fatal human disease. The complete genome of SARS-CoV has been identified, as well as common variants thereof. The genome of SARS-CoV is a 29,727-nucleotide polyadenylated RNA, has 11 open reading frames, and 41% of the residues are G or C. The genomic organization is typical of coronaviruses, with the characteristic gene order (5'-replicase (rep), spike (S), envelope (E), membrane (M), nucleocapsid (N)-3' and short untranslated regions at both termini. The SARS-CoV rep gene, which comprises about two-thirds of the genome, is predicted to encode two polyproteins that undergo co-translational proteolytic processing. There are four open reading frames (ORFs) downstream of rep that are predicted to encode the structural proteins, S, E, M and N. The hemagglutinin-esterase gene, which is present between ORF1b and S in group 2 and some group 3 coronaviruses was not found.

The amino acid and complete coding sequences of the SARS-CoV genomes are known may be found in for example, GenBank Accession Nos. AY502923.1; AP006559.1; AP006558.1; AY313906.1; AY345986.1; AY502931.1; AY282752.2; AY559097.1; AY559081.1; DQ182595.1; AY291451.1; AY568539.1; AY613947.1; and AY390556.1, the entire contents of each of which are incorporated herein by reference.

The term "SARS-CoV," as used herein, also refers to naturally occurring RNA sequence variations of the SARS-CoV genome.

As use herein, the term "the Middle East respiratory syndrome coronavirus" or "MERS-CoV", refers to a coronavirus that causes the Middle East respiratory syndrome (MERS), which was first identified in 2012. MERS-CoV is closely related to severe acute respiratory syndrome (SARS) coronavirus (SARS-CoV). Clinically similar to SARS, MERS-CoV infection leads to severe respiratory illness with renal failure.

The amino acid and complete coding sequences of the MERS-CoV genomes are known and may be found in for example, GenBank Accession Nos. MK462243.1; MK462244.1; MK462245.1; MK462246.1; MK462247.1; MK462248.1; MK462249.1; MK462250.1; MK462251.1; MK462252.1; MK462253.1; MK462254.1; MK462255.1; MK462256.1; MK483839.1; and MH822886.1, the entire contents of each of which are incorporated herein by reference.

The term "MERS-CoV," as used herein, also refers to naturally occurring RNA sequence variations of the MERS-CoV genome.

As use herein, the terms "severe acute respiratory syndrome coronavirus 2," "SARS-CoV-2," "2019-nCoV," refer to the novel coronavirus that caused a pneumonia outbreak first reported in Wuhan, China in December 2019 ("COVID-19"). Phylogenetic analysis of the complete viral genome (29,903 nucleotides) revealed that SARS-CoV-2 was most closely related (89.1% nucleotide similarity similarity) to SARS-CoV.

The amino acid and complete coding sequences of the SARS-CoV-2 genomes are known and may be found in for example, the GISAID EpiCoV™ Database (db.cngb.org/gisaid/), including Accession nos. EPI_ISL_402119; EPI_ISL_402120; EPI_ISL_402121; EPI_ISL_402123; EPI_ISL_402124; EPI_ISL_402125; EPI_ISL_402127; EPI_ISL_402128; EPI_ISL_402129; EPI_ISL_402130; EPI_ISL_402132; EPI_ISL_403928; EPI_ISL_403929; EPI_ISL_403930; EPI_ISL_403931; EPI_ISL_403932; EPI_ISL_403933; EPI_ISL_403934; EPI_ISL_403935; EPI_ISL_403936; EPI_ISL_403937; EPI_ISL_403962; EPI_ISL_404228; EPI_ISL_404253; and EPI_ISL_404895, the entire contents of wach of which are incorporated herein by reference.

The term "SARS-CoV-2," as used herein, also refers to naturally occurring RNA sequence variations of the SARS-CoV-2 genome.

Additional examples of coronavirus genomes and mRNA sequences are readily available using publicly available databases, e.g., GenBank, UniProt, and OMIM.

As used herein, the term "Transmembrane Serine Protease 2," used interchangeably with the term "TMPRSS2," refers to the well-known gene and polypeptide, also known in the art as Serine Protease 10, and SS10. The term "TMPRSS2" includes human TMPRSS2, the amino acid and nucleotide sequences of which may be found in, for example, GenBank Accession No. NM_005656.4 (GI: 1581462622; SEQ ID NO:1) and GenBank Accession No. NM_001135099.1 (GI: 227499989; SEQ ID NO: 2); mouse TMPRSS2, the amino acid and nucleotide sequence of which may be found in, for example, GenBank Accession No. NM_015775.2 (GI: 34328225, SEQ ID NO: 3); and rat TMPRSS2, the amino acid and nucleotide sequence of which may be found in, for example, GenBank Accession: NM_130424.3 (GI: 829708433; SEQ ID NO: 4).

The term "TMPRSS2" also includes Macaca fascicularis TMPRSS2, the amino acid and nucleotide sequence of which may be found in, for example, GenBank Accession No. XM_005548643.2 (GI: 982237460; SEQ ID NO: 5)

Additional examples of TMPRSS2 mRNA sequences are readily available using, e.g., GenBank, UniProt, OMIM, and the Macaca genome project web site.

Exemplary TMPRSS2 nucleotide sequences may also be found in SEQ ID NOs:1-10. SEQ ID NOs:6-10 are the reverse complement sequences of SEQ ID NOs:1-5, respectively.

Further information on TMPRSS2 is provided, for example in the NCBI Gene database at www.ncbi.nlm.nih.gov/gene/7113.

The entire contents of each of the foregoing GenBank Accession numbers and the Gene database numbers are incorporated herein by reference as of the date of filing this application.

The terms "transmembrane serine protease 2" and "TMPRSS2," as used herein, also refers to naturally occurring DNA sequence variations of the TMPRSS2 gene. Numerous sequence variations within the TMPRSS2 gene have been identified and may be found at, for example, NCBI dbSNP and UniProt (see, e.g., www.ncbi.nlm.nih.gov/snp?LinkName=gene_snp&from_uid=1773), the entire contents of which is incorporated herein by reference as of the date of filing this application.

As used herein, "target sequence" refers to a contiguous portion of the nucleotide sequence of an mRNA molecule formed during the transcription of a TMPRSS2 gene, including mRNA that is a product of RNA processing of a primary transcription product. In one embodiment, the target portion of the sequence will be at least long enough to serve as a substrate for RNAi-directed cleavage at or near that portion of the nucleotide sequence of an mRNA molecule formed during the transcription of a TMPRSS2 gene. In one embodiment, the target sequence is within the protein coding region of the TMPRSS2 gene. In another embodiment, the target sequence is within the 3' UTR of the TMPRSS2 gene.

The target sequence may be from about 19-36 nucleotides in length, e.g., preferably about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. RNA interference (RNAi) is a process that directs the sequence-specific degradation of mRNA. RNAi modulates, e.g., inhibits, the expression of a TMPRSS2 gene in a cell, e.g., a cell within a subject, such as a mammalian subject.

In one embodiment, an RNAi agent of the disclosure includes a single stranded RNAi that interacts with a target RNA sequence, e.g., a TMPRSS2 mRNA sequence, to direct the cleavage of the target RNA. Without wishing to be bound by theory it is believed that long double stranded RNA introduced into cells is broken down into double-stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the disclosure relates to a single stranded RNA (ssRNA) (the antisense strand of a siRNA duplex) generated within a cell and which promotes the formation of a RISC complex to effect silencing of the target gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, a "RNAi agent" for use in the compositions and methods of the disclosure is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., a TMPRSS2 mRNA sequence. In some embodiments of the disclosure, a double stranded RNA (dsRNA) triggers the degradation of a target RNA, e.g., an mRNA, through a post-transcriptional gene-silencing mechanism referred to herein as RNA interference or RNAi.

In general, a dsRNA molecule can include ribonucleotides, but as described in detail herein, each or both strands can also include one or more non-ribonucleotides, e.g., a deoxyribonucleotide, a modified nucleotide. In addition, as used in this specification, an "RNAi agent" may include ribonucleotides with chemical modifications; an RNAi agent may include substantial modifications at multiple nucleotides.

As used herein, the term "modified nucleotide" refers to a nucleotide having, independently, a modified sugar moiety, a modified internucleotide linkage, or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the disclosure include all types of modifications disclosed herein or known in the art. Any such modifications, as used in a siRNA type molecule, are encompassed by "RNAi agent" for the purposes of this specification and claims.

In certain embodiments of the instant disclosure, inclusion of a deoxy-nucleotide—which is acknowledged as a naturally occurring form of nucleotide—if present within a RNAi agent can be considered to constitute a modified nucleotide.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 4, at least 5, at least 6, at least 7, at least 8, at least 9, at least 10, at least 20, at least 23 or more unpaired nucleotides or nucleotides not directed to the target site of the dsRNA. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

In certain embodiment, the two strands of double-stranded oligomeric compound can be linked together. The two strands can be linked to each other at both ends, or at one end only. By linking at one end is meant that 5'-end of first strand is linked to the 3'-end of the second strand or 3'-end of first strand is linked to 5'-end of the second strand. When the two strands are linked to each other at both ends, 5'-end of first strand is linked to 3'-end of second strand and 3'-end of first strand is linked to 5'-end of second strand. The two strands can be linked together by an oligonucleotide linker including, but not limited to, (N)n; wherein N is independently a modified or unmodified nucleotide and n is 3-23. In some embodiments, n is 3-10, e.g., 3, 4, 5, 6, 7, 8, 9, or 10. In some embodiments, the oligonucleotide linker is selected from the group consisting of GNRA, (G)4, (U)4, and (dT)4, wherein N is a modified or unmodified nucleotide and R a modified or unmodified purine nucleotide. Some of the nucleotides in the linker can be involved in base-pair interactions with other nucleotides in the linker. The two strands can also be linked together by a non-nucleosidic linker, e.g. a linker described herein. It will be appreciated by one of skill in the art that any oligonucleotide chemical modifications or variations describe herein can be used in the oligonucleotide linker.

Hairpin and dumbbell type oligomeric compounds will have a duplex region equal to or at least 14, 15, 15, 16, 17, 18, 19, 29, 21, 22, 23, 24, or 25 nucleotide pairs. The duplex region can be equal to or less than 200, 100, or 50, in length. In some embodiments, ranges for the duplex region are 15-30, 17 to 23, 19 to 23, and 19 to 21 nucleotides pairs in length.

The hairpin oligomeric compounds can have a single strand overhang or terminal unpaired region, in some embodiments at the 3', and in some embodiments on the antisense side of the hairpin. In some embodiments, the overhangs are 1-4, more generally 2-3 nucleotides in length. The hairpin oligomeric compounds that can induce RNA interference are also referred to as "shRNA" herein.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA, each strand of which is 24-30 nucleotides in length, that interacts with a target RNA sequence, e.g., a TMPRSS2 mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188).

In one embodiment, an RNAi agent of the invention is a dsRNA agent, each strand of which comprises 19-23 nucleotides that interacts with a TMPRSS2 mRNA sequence to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). In one embodiment, an RNAi agent of the invention is a dsRNA of 24-30 nucleotides that interacts with a TMPRSS2 mRNA sequence to direct the cleavage of the target RNA.

As used herein, the term "nucleotide overhang" refers to at least one unpaired nucleotide that protrudes from the duplex structure of a RNAi agent, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double stranded over its entire length.

The term "antisense strand" or "guide strand" refers to the strand of an iRNA, e.g., a dsRNA, which includes a region that is substantially complementary to a target sequence, e.g., a TMPRSS2 mRNA sequence.

As used herein, the term "region of complementarity" refers to the region on the antisense strand that is substantially complementary to a sequence, for example a target sequence, e.g., a TMPRSS2 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- or 3'-terminus of the RNAi agent.

In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(es) is not in the seed region.

Thus, an RNAi agent as described herein can contain one or more mismatches to the target sequence. In one embodiment, a RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of a TMPRSS2 gene, generally does not contain any mismatch within the central 13 nucleotides. The methods described herein or methods known in the art can be used to determine whether an RNAi agent containing a mismatch to a target sequence is effective in inhibiting the expression of a TMPRSS2 gene. Consideration of the efficacy of RNAi agents with mismatches in inhibiting expression of a TMPRSS2 gene is important, especially if the particular region of complementarity in a TMPRSS2 gene is known to vary.

The term "sense strand" or "passenger strand" as used herein, refers to the strand of a RNAi agent that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within a RNAi agent, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of a RNAi agent and a target sequence, as will be understood from the context of their use.

As used herein, a polynucleotide that is "substantially complementary to at least part of" a messenger RNA (mRNA) or target sequence refers to a polynucleotide that is substantially complementary to a contiguous portion of the mRNA of interest or target sequence (e.g., an mRNA encoding TMPRSS2). For example, a polynucleotide is complementary to at least a part of a TMPRSS2 RNA if the sequence is substantially complementary to a non-interrupted portion of an mRNA encoding TMPRSS2.

Accordingly, in some embodiments, the antisense strand polynucleotides disclosed herein are fully complementary to the target TMPRSS2 sequence.

In other embodiments, the antisense strand polynucleotides disclosed herein are substantially complementary to the target TMPRSS2 sequence and comprise a contiguous nucleotide sequence which is at least about 80% complementary over its entire length to the equivalent region of the nucleotide sequence of SEQ ID NOs: 1-5 for TMPRSS2, or a fragment of SEQ ID Nos: 1-5, such as about 85%, about 90%, or about 95% complementary.

In other embodiments, the antisense polynucleotides disclosed herein are substantially complementary to the target TMPRSS2 sequence and comprise a contiguous nucleotide sequence which is at least about 80% complementary over its entire length to any one of the sense strand nucleotide sequences in any one of Tables 2 and 3, or a fragment of any one of the sense strand nucleotide sequences in any one of Tables 2 and 3, such as about 85%, about 90%, or about 95% complementary.

In one embodiment, an RNAi agent of the disclosure includes a sense strand that is substantially complementary to an antisense polynucleotide which, in turn, is the same as a target TMPRSS2 sequence, and wherein the sense strand polynucleotide comprises a contiguous nucleotide sequence which is at least about 80% complementary over its entire length to the equivalent region of the nucleotide sequence of SEQ ID NOs: 6-10, or a fragment of any one of SEQ ID NOs: 6-10, such as about 85%, about 90%, or about 95% complementary.

In some embodiments, an iRNA of the invention includes a sense strand that is substantially complementary to an antisense polynucleotide which, in turn, is complementary to a target TMPRSS2 sequence, and wherein the sense strand polynucleotide comprises a contiguous nucleotide sequence which is at least about 80% complementary over its entire length to any one of the antisense strand nucleotide sequences in any one of any one of Tables 2 and 3, or a fragment of any one of the antisense strand nucleotide sequences in any one of Tables 2 and 3, such as about 85%, about 90%, or about 95% complementary.

In some embodiments, the double-stranded region of a double-stranded iRNA agent is equal to or at least, 10, 11, 12, 13, 14, 15, 16, 17, 18, 19, 20, 21, 22, 23, 23, 24, 25, 26, 27, 28, 29, 30 or more nucleotide pairs in length.

In some embodiments, the antisense strand of a double-stranded iRNA agent is equal to or at least 14, 15, 16, 17, 18, 19, 20, 21, 22, 23, 23, 24, 25, 26, 27, 28, 29, or 30 nucleotides in length.

In some embodiments, the sense strand of a double-stranded iRNA agent is equal to or at least 10, 11, 12, 13, 14, 15, 16, 17, 18, 19, 20, 21, 22, 23, 23, 24, 25, 26, 27, 28, 29, or 30 nucleotides in length.

In one embodiment, the sense and antisense strands of the double-stranded iRNA agent are each independently 15 to 30 nucleotides in length.

In one embodiment, the sense and antisense strands of the double-stranded iRNA agent are each independently 19 to 25 nucleotides in length.

In one embodiment, the sense and antisense strands of the double-stranded iRNA agent are each independently 21 to 23 nucleotides in length.

In one embodiment, the sense strand of the iRNA agent is 21-nucleotides in length, and the antisense strand is 23-nucleotides in length, wherein the strands form a double-stranded region of 21 consecutive base pairs having a 2-nucleotide long single stranded overhangs at the 3'-end.

In one aspect of the invention, an agent for use in the methods and compositions of the invention is a single-stranded antisense nucleic acid molecule that inhibits a target mRNA via an antisense inhibition mechanism. The single-stranded antisense RNA molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense RNA molecule may be about 15 to about 30 nucleotides in length and have a sequence that is complementary to a target sequence. For example, the single-stranded antisense RNA molecule may comprise a sequence that is at least about 15, 16, 17, 18, 19, 20, or more contiguous nucleotides from any one of the antisense sequences described herein.

In one embodiment, at least partial suppression of the expression of a TMPRSS2 gene, is assessed by a reduction of the amount of TMPRSS2 mRNA which can be isolated from or detected in a first cell or group of cells in which a TMPRSS2 gene is transcribed and which has or have been treated such that the expression of a TMPRSS2 gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

In one embodiment, inhibition of expression is determined by the dual luciferase method in Example 1 wherein the RNAi agent is present at 10 nM.

The phrase "contacting a cell with an RNAi agent," such as a dsRNA, as used herein, includes contacting a cell by any possible means. Contacting a cell with an RNAi agent includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, via inhalation, intranasal administration, or intratracheal administration, by injecting the RNAi agent into or near the tissue where the cell is located, e.g., the pulmonary system, or by injecting the RNAi agent into another area, or to the bloodstream or the subcutaneous space, such that the agent will subsequently reach the tissue where the cell to be contacted is located. For example, the RNAi agent may contain or be coupled to a ligand, e.g., a lipophilic moiety or moieties as described below and further detailed, e.g., in PCT Publication No. WO 2019/217459, the entire contents of which is incorporated herein by reference, that directs or otherwise stabilizes the RNAi agent at a site of interest, e.g., the pulmonary system. In some embodiments, the RNAi agent may contain or be coupled to a ligand, e.g., one or more GalNAc derivatives as described below, that directs or otherwise stabilizes the RNAi agent at a site of interest, e.g., the liver. In other embodiments, the RNAi agent may contain or be coupled to a lipophilic moiety or moieties and one or more GalNAc derivatives. Combinations of in vitro and in vivo methods of contacting are also possible. For example, a cell may also be contacted in vitro with an RNAi agent and subsequently transplanted into a subject.

In one embodiment, contacting a cell with an RNAi agent includes "introducing" or "delivering the RNAi agent into the cell" by facilitating or effecting uptake or absorption into the cell. Absorption or uptake of a RNAi agent can occur through unaided diffusive or active cellular processes, or by auxiliary agents or devices. Introducing a RNAi agent into a cell may be in vitro or in vivo. For example, for in vivo introduction, a RNAi agent can be injected into a tissue site or administered systemically. In vitro introduction into a cell includes methods known in the art such as electroporation and lipofection. Further approaches are described herein below or are known in the art.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J. Chem. Inf. Comput. Sci.* 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded RNAi agent, conjugated to one or more lipophilic moieties, can be measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In one embodiment, the plasma protein binding assay determined is an electrophoretic mobility shift assay (EMSA) using human serum albumin protein. An exemplary protocol of this binding assay is illustrated in detail in, e.g., PCT Publication No. WO 2019/217459. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

The term "lipid nanoparticle" or "LNP" is a vesicle comprising a lipid layer encapsulating a pharmaceutically active molecule, such as a nucleic acid molecule, e.g., a rNAi agent or a plasmid from which a RNAi agent is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), or a non-primate (such as a cow, a pig, a horse, a goat, a rabbit, a sheep, a hamster, a guinea pig, a cat, a dog, a rat, or a mouse), or a bird that expresses the target gene, either endogenously or heterologously. In a preferred embodiment, the subject is a human, such as a human being treated or assessed for a disease, disorder, or condition that would benefit from reduction in TMPRSS2 expression; a human at risk for a disease, disorder, or condition that would benefit from reduction in TMPRSS2 expression; a human having a disease, disorder, or condition that would benefit from reduction in TMPRSS2 expression; or human being treated for a disease, disorder, or condition that would benefit from reduction in TMPRSS2 expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result including, but not limited to, alleviation or amelioration of one or more signs or symptoms associated with TMPRSS2 expression or TMPRSS2 protein production, e.g., a TMPRSS2-associated disease, e.g., a coronavirus-associated disease, e.g., COVID-19. Treatment also includes a reduction of one or more sign or symptoms associated with unwanted TMPRSS2 expression; diminishing the extent of unwanted TMPRSS2 activation or stabilization; amelioration or palliation of unwanted TMPRSS2 activation or stabilization. "Treatment" can also mean prolonging survival as compared to expected survival in the absence of treatment.

The term "lower" in the context of the level of TMPRSS2 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of TMPRSS2 in a subject is preferably down to a level accepted as within the range of normal for an individual without such disorder. In certain embodiments, the expression of the target is normalized, i.e., decreased towards or to a level accepted as within the range of normal for an individual without such disorder, e.g., viral load, blood oxygen level, white blood cell count, kidney function, liver function. As used here, "lower" in a subject can refer to lowering of gene expression or protein production in a cell in a subject does not require lowering of expression in all cells or tissues of a subject. For example, as used herein, lowering in a subject can include lowering of gene expression or protein production or viral replication in a subject.

The term "lower" can also be used in association with normalizing a symptom of a disease or condition, i.e. decreasing the difference between a level in a subject suffering from a TMPRSS2-associated disease towards or to a level in a normal subject not suffering from a TMPRSS2-associated disease. As used herein, if a disease is associated with an elevated value for a symptom, "normal" is considered to be the upper limit of normal. If a disease is associated with a decreased value for a symptom, "normal" is considered to be the lower limit of normal.

As used herein, "prevention" or "preventing," when used in reference to a disease, disorder, or condition thereof, that would benefit from a reduction in expression of a TMPRSS2 gene or production of a TMPRSS2 protein, refers to a reduction in the likelihood that a subject will develop a symptom associated with such a disease, disorder, or condition, e.g., a symptom of a TMPRSS2-associated disease, e.g., COVID-19. The failure to develop a disease, disorder, or condition, or the reduction in the development of a symptom associated with such a disease, disorder, or condition, e.g., pneumonia (e.g., by at least about 10% on a clinically accepted scale for that disease or disorder), or the exhibition of delayed symptoms delayed (e.g., by days, weeks, months or years) is considered effective prevention.

As used herein, the term "TMPRSS2-associated disease," is a disease or disorder that would benefit from reduction in the expression or activity of TMPRSS2. Such TMPRSS2-associated diseases include a coronavirus-associated disease.

The term "coronavirus-associated disease," is a disease or disorder that is caused by, or associated with a coronavirus infection, coronavirus genome expression or coronavirus protein production. The term "coronavirus-associated disease" includes a disease, disorder or condition that would benefit from a decrease in coronavirus S protein priming, viral genome expression, cellular (viral) entry, viral replication, or viral protein activity.

Non-limiting examples of coronavirus-associated diseases include, for example, disease or disorders caused by infection with human coronavirus 229E (HCoV-229E), human coronavirus NL63 (HCoV-NL63), human coronavirus OC43 (HCoV-OC43), human coronavirus HKU1 (HCoV-HKU1), severe acute respiratory syndrome coronavirus (SARS), the Middle East respiratory syndrome coronavirus (MERS), and severe acute respiratory syndrome coronavirus 2 (SARS-CoV-2 or COVID-19). The symptoms for a coronavirus-associated disease depend on the type of coronavirus and how serious the infection is. Patients with a mild to moderate upper-respiratory infection may develop symptoms such as runny nose, sneezing, headache, cough, sore throat, fever, or short of breath. In more severe cases, coronavirus infection can cause pneumonia, severe acute respiratory syndrome, kidney failure and even death. Further details regarding signs and symptoms of the various diseases or conditions are provided herein and are well known in the art.

"Therapeutically effective amount," as used herein, is intended to include the amount of an RNAi agent that, when administered to a subject having a coronavirus-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of a RNAi agent that, when administered to a subject having a TMPRSS2-associated disorder, e.g., a coronavirus-associated disorder, such as COVID-19, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of a RNAi agent that produces some desired local or systemic effect at a reasonable benefit/risk ratio applicable to any treatment. A RNAi agent employed in the methods of the present disclosure may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, bronchial fluids, sputum, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from a nasal swab. In certain embodiments, samples may be derived from a throat swab. In certain embodiments, samples may be derived from the lung, or certain types of cells in the lung. In some embodiments, the samples may be derived from the bronchioles. In some embodiments, the samples may be derived from the bronchus. In some embodiments, the samples may be derived from the alveoli. In other embodiments, a "sample derived from a subject" refers to liver tissue (or subcomponents thereof) derived from the subject. In some embodiments, a "sample derived from a subject" refers to blood drawn from the subject or plasma or serum derived therefrom. In further embodiments, a "sample derived from a subject" refers to pulmonary tissue (or subcomponents thereof) derived from the subject.

II. RNAi Agents of the Disclosure

Described herein are RNAi agents which inhibit the expression of a TMPRSS2 gene. In one embodiment, the RNAi agent includes double stranded ribonucleic acid (dsRNA) molecules for inhibiting the expression of a TMPRSS2 gene in a cell, such as a cell within a subject, e.g., a mammal, such as a human, e.g., a subject having a TMPRSS2-associated disorder, e.g., a coronavirus-associated disorder, e.g., a subject having a coronavirus infection, e.g., a subject having Severe Acute Respiratory Syndrome 2 (SARS-CoV-2; COVID-19), Severe Acute Respiratory Syndrome (SARS-CoV), or Middle East Respiratory Syndrome (MERS-CoV). The dsRNA includes an antisense strand having a region of complementarity which is complementary to at least a part of a target RNA, e.g., an mRNA formed in the expression of a TMPRSS2 gene. The region of complementarity is about 15-30 nucleotides or less in length. Upon contact with a cell expressing the TMPRSS2 gene, the RNAi agent inhibits the expression of the TMPRSS2 gene (e.g., a human gene, a primate gene, a non-primate gene) by at least 50% as assayed by, for example, a PCR or branched DNA (bDNA)-based method, or by a protein-based method, such as by immunofluorescence analysis, using, for example, western blotting or flowcytometric techniques. In preferred embodiments, inhibition of expression is by at least 50% as assayed by the Dual-Glo luciferase assay in Example 1 where the siRNA is at a 10 nM concentration.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. For example, the target sequence can be derived from the sequence of an mRNA formed during the expression of a TMPRSS2 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain preferred embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the dsRNA is 15 to 23 nucleotides in length, or 25 to 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 15 to 36 base pairs, e.g., 15-36, 15-35, 15-34, 15-33, 15-32, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs, for example, 19-21 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, a RNAi agent useful to target TMPRSS2 expression is not generated in the target cell by cleavage of a larger dsRNA.

A dsRNA as described herein can further include one or more single-stranded nucleotide overhangs e.g., 1, 2, 3, or 4 nucleotides. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA. In certain embodiments, longer, extended overhangs are possible.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

An siRNA can be produced, e.g., in bulk, by a variety of methods. Exemplary methods include: organic synthesis and RNA cleavage, e.g., in vitro cleavage.

An siRNA can be made by separately synthesizing a single stranded RNA molecule, or each respective strand of a double-stranded RNA molecule, after which the component strands can then be annealed.

A large bioreactor, e.g., the OligoPilot II from Pharmacia Biotec AB (Uppsala Sweden), can be used to produce a large amount of a particular RNA strand for a given siRNA. The OligoPilotII reactor can efficiently couple a nucleotide using only a 1.5 molar excess of a phosphoramidite nucleotide. To make an RNA strand, ribonucleotides amidites are used. Standard cycles of monomer addition can be used to synthesize the 21 to 23 nucleotide strand for the siRNA. Typically, the two complementary strands are produced separately and then annealed, e.g., after release from the solid support and deprotection.

Organic synthesis can be used to produce a discrete siRNA species. The complementary of the species to a TMPRSS2 gene can be precisely specified. For example, the species may be complementary to a region that includes a polymorphism, e.g., a single nucleotide polymorphism. Further the location of the polymorphism can be precisely defined. In some embodiments, the polymorphism is located in an internal region, e.g., at least 4, 5, 7, or 9 nucleotides from one or both of the termini.

In one embodiment, RNA generated is carefully purified to remove endsiRNA is cleaved in vitro into siRNAs, for example, using a Dicer or comparable RNAse III-based activity. For example, the dsiRNA can be incubated in an in vitro extract from Drosophila or using purified components, e.g., a purified RNAse or RISC complex (RNA-induced silencing complex). See, e.g., Ketting et al. *Genes Dev* 2001 Oct. 15; 15(20):2654-9 and Hammond Science 2001 Aug. 10; 293(5532):1146-50.

dsiRNA cleavage generally produces a plurality of siRNA species, each being a particular 21 to 23 nucleotide fragment of a source dsiRNA molecule. For example, siRNAs that include sequences complementary to overlapping regions and adjacent regions of a source dsiRNA molecule may be present.

Regardless of the method of synthesis, the siRNA preparation can be prepared in a solution (e.g., an aqueous or organic solution) that is appropriate for formulation. For example, the siRNA preparation can be precipitated and redissolved in pure double-distilled water, and lyophilized. The dried siRNA can then be resuspended in a solution appropriate for the intended formulation process.

In one aspect, a dsRNA of the disclosure includes at least two nucleotide sequences, a sense sequence and an antisense sequence. The sense strand sequence for TMPRSS2 may be selected from the group of sequences provided in any one of Tables 2 and 3, and the corresponding nucleotide sequence of the antisense strand of the sense strand may be selected from the group of sequences of any one of Tables 2 and 3. In this aspect, one of the two sequences is complementary to the other of the two sequences, with one of the sequences being substantially complementary to a sequence of an mRNA generated in the expression of a TMPRSS2 gene. As such, in this aspect, a dsRNA will include two oligonucleotides, where one oligonucleotide is described as the sense strand (passenger strand) in any one of Tables 2 and 3, and the second oligonucleotide is described as the corresponding antisense strand (guide strand) of the sense strand in any one of Tables 2 and 3 for TMPRSS2.

In one embodiment, the substantially complementary sequences of the dsRNA are contained on separate oligonucleotides. In another embodiment, the substantially complementary sequences of the dsRNA are contained on a single oligonucleotide.

It will be understood that, although the sequences provided herein are described as modified or conjugated sequences, the RNA of the RNAi agent of the disclosure e.g., a dsRNA of the disclosure, may comprise any one of the sequences set forth in any one of Tables 2 and 3 that is unmodified, un-conjugated, or modified or conjugated differently than described therein. One or more lipophilic ligands or one or more GalNAc ligands can be included in any of the positions of the RNAi agents provided in the instant application.

The skilled person is well aware that dsRNAs having a duplex structure of about 20 to 23 base pairs, e.g., 21, base pairs have been hailed as particularly effective in inducing RNA interference (Elbashir et al., (2001) *EMBO J.*, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of a TMPRSS2 gene by not more than 10, 15, 20, 25, or 30% inhibition from a dsRNA comprising the full sequence using the in vitro assay with Cos7 and a 10 nM concentration of the RNA agent and the PCR assay as provided in the examples herein, are contemplated to be within the scope of the present disclosure.

In addition, the RNAs described herein identify a site(s) in a TMPRSS2 transcript that is susceptible to RISC-mediated cleavage. As such, the present disclosure further features RNAi agents that target within this site(s). As used herein, a RNAi agent is said to target within a particular site of an RNA transcript if the RNAi agent promotes cleavage of the transcript anywhere within that particular site. Such a RNAi agent will generally include at least about 15 contiguous nucleotides, preferably at least 19 nucleotides, from one of the sequences provided herein coupled to additional nucleotide sequences taken from the region contiguous to the selected sequence in a TMPRSS2 gene.

An RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of a TMPRSS2 gene generally does not contain any mismatch within the central 13 nucleotides. The methods described herein or methods known in the art can be used to determine whether an RNAi agent containing a mismatch to a target sequence is effective in inhibiting the expression of a TMPRSS2 gene. Consideration of the efficacy of RNAi agents with mismatches in inhibiting expression of a TMPRSS2 gene is important, especially if the particular region of complementarity in a TMPRSS2 gene is known to mutate.

III. Modified RNAi Agents of the Disclosure

In one embodiment, the RNA of the RNAi agent of the disclosure e.g., a dsRNA, is unmodified, and does not comprise, e.g., chemical modifications or conjugations known in the art and described herein. In preferred embodiments, the RNA of an RNAi agent of the disclosure, e.g., a dsRNA, is chemically modified to enhance stability or other beneficial characteristics. In certain embodiments of the disclosure, substantially all of the nucleotides of an RNAi agent of the disclosure are modified. In other embodiments of the disclosure, all of the nucleotides of an RNAi agent of the disclosure are modified. RNAi agents of the disclosure in which "substantially all of the nucleotides are modified" are largely but not wholly modified and can include not more than 5, 4, 3, 2, or 1 unmodified nucleotides. In still other embodiments of the disclosure, RNAi agents of the disclosure can include not more than 5, 4, 3, 2 or 1 modified nucleotides.

The nucleic acids featured in the disclosure can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of RNAi agents useful in the embodiments described herein include, but are not limited to, RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified RNAi agent will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, e.g., sodium salts, mixed salts and free acid forms are also included.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276, 019; 5,278,302; 5,286,717; 5,321,131; 5,399,676; 5,405, 939; 5,453,496; 5,455,233; 5,466,677; 5,476,925; 5,519, 126; 5,536,821; 5,541,316; 5,550,111; 5,563,253; 5,571, 799; 5,587,361; 5,625,050; 6,028,188; 6,124,445; 6,160, 109; 6,169,170; 6,172,209; 6, 239,265; 6,277,603; 6,326, 199; 6,346,614; 6,444,423; 6,531,590; 6,534,639; 6,608, 035; 6,683,167; 6,858,715; 6,867,294; 6,878,805; 7,015, 315; 7,041,816; 7,273,933; 7,321,029; and U.S. Pat. No. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones;

alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in RNAi agents, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the RNAi agents of the disclosure are described in, for example, in Nielsen et al., *Science*, 1991, 254, 1497-1500.

Some embodiments featured in the disclosure include RNAs with phosphorothioate backbones and oligonucleosides with heteroatom backbones, and in particular —$CH_2$—NH—$CH_2$—, —$CH_2$—N($CH_3$)—O—$CH_2$-[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$-[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The RNAi agents, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$O$CH_3$, O($CH_2$)$_n$NH$_2$, O($CH_2$)$_n$CH$_3$, O($CH_2$)$_n$ONH$_2$, and O($CH_2$)$_n$ON[($CH_2$)$_n$$CH_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of a RNAi agent, or a group for improving the pharmacodynamic properties of a RNAi agent, and other substituents having similar properties. In some embodiments, the modification includes a 2'-methoxyethoxy (2' CH$_2$CH$_2$OCH$_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-OCH$_3$), 2'-aminopropoxy (2'-OCH$_2$CH$_2$CH$_2$NH$_2$), 2'-O-hexadecyl, and 2'-fluoro (2'-F). Similar modifications can also be made at other positions on the RNA of a RNAi agent, particularly the 3' position of the sugar on the 3' terminal nucleotide or in 2'-5' linked dsRNAs and the 5' position of 5' terminal nucleotide. RNAi agents can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An RNAi agent of the disclosure can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition*, 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An RNAi agent of the disclosure can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

An RNAi agent of the disclosure can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the disclosure may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the disclosure include without limitation nucleosides comprising a bridge between the 4' and the 2' ribosyl ring atoms. In certain embodiments, the antisense polynucleotide agents of the disclosure include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J.*
*Org. Chem.*, 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative US Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

An RNAi agent of the disclosure can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-O-2' bridge. In one embodiment, a constrained ethyl nucleotide is in the S conformation referred to herein as "S-cEt."

An RNAi agent of the disclosure may also include one or more "conformationally restricted nucleotides" ("CRN"). CRN are nucleotide analogs with a linker connecting the C2' and C4' carbons of ribose or the —C3' and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US 2013/0190383; and WO 2013/036868, the entire contents of each of which are hereby incorporated herein by reference.

In some embodiments, a RNAi agent of the disclosure comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in WO 2011/005861.

Other modifications of a RNAi agent of the disclosure include a 5' phosphate or 5' phosphate mimic, e.g., a 5'-terminal phosphate or phosphate mimic on the antisense strand of a RNAi agent. Suitable phosphate mimics are disclosed in, for example US 2012/0157511, the entire contents of which are incorporated herein by reference.

A. Modified RNAi Agents Comprising Motifs of the Disclosure

In certain aspects of the disclosure, the double-stranded RNAi agents of the disclosure include agents with chemical modifications as disclosed, for example, in WO 2013/075035, the entire contents of which are incorporated herein by reference. As shown herein and in WO 2013/075035, a superior result may be obtained by introducing one or more motifs of three identical modifications on three consecutive nucleotides into a sense strand or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense or antisense strand. The RNAi agent may be optionally conjugated with a lipophilic ligand, e.g., a C16 ligand, for instance on the sense strand. The RNAi agent may be optionally modified with a (S)-glycol nucleic acid (GNA) modification, for instance on one or more residues of the antisense strand. The resulting RNAi agents present superior gene silencing activity.

Accordingly, the disclosure provides double stranded RNAi agents capable of inhibiting the expression of a target genome or gene (i.e., a TMPRSS2 gene) in vivo. The RNAi agent comprises a sense strand and an antisense strand. Each strand of the RNAi agent may be 15-30 nucleotides in length. For example, each strand may be 16-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length. In certain embodiments, each strand is 19-23 nucleotides in length.

The sense strand and antisense strand typically form a duplex double stranded RNA ("dsRNA"), also referred to herein as an "RNAi agent." The duplex region of an RNAi agent may be 15-30 nucleotide pairs in length. For example, the duplex region can be 16-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length. In preferred embodiments, the duplex region is 19-21 nucleotide pairs in length.

In one embodiment, the RNAi agent may contain one or more overhang regions or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In preferred embodiments, the nucleotide overhang region is 2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-O-methyl, thymidine (T), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5' end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (e.g., a lipophilic ligand, optionally a C16 ligand).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two, or three nucleotides in the duplex region.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense or antisense strand.

In one embodiment, the sense strand sequence may be represented by formula (I):

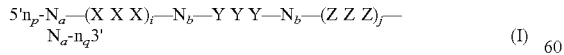

(I)

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;
each $n_p$ and $n_q$ independently represent an overhang nucleotide;
wherein $N_b$ and Y do not have the same modification; and
XXX, YYY and ZZZ each independently represent one motif of three identical modifications on three consecutive nucleotides. Preferably YYY is all 2'-F modified nucleotides.

In one embodiment, the $N_a$ or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of— the sense strand, the count starting from the $1^{st}$ nucleotide, from the 5'-end; or optionally, the count starting at the $1^{st}$ paired nucleotide within the duplex region, from the 5'-end.

In one embodiment, i is 1 and j is 0, or i is 0 and j is 1, or both i and j are 1. The sense strand can therefore be represented by the following formulas:

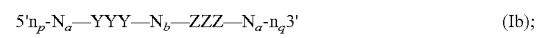

(Ib);

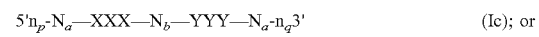

(Ic); or

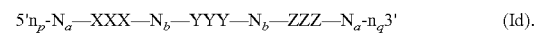

(Id).

When the sense strand is represented by formula (Ib), $N_b$ represents an oligonucleotide sequence comprising 0-10, 0-7, 0-5, 0-4, 0-2 or 0 modified nucleotides.

Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

(Ia).

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

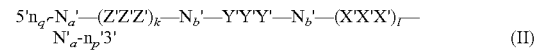

(II)

wherein:
k and l are each independently 0 or 1
p' and q' are each independently 0-6;
each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1$^{st}$ nucleotide, from the 5'-end; or optionally, the count starting at the 1$^{st}$ paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

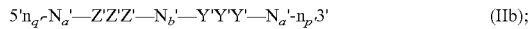 (IIb);

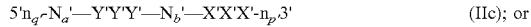 (IIc); or

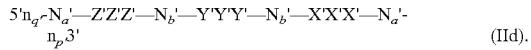 (IId).

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

 (Ia).

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1$^{st}$ nucleotide from the 5'-end, or optionally, the count starting at the 1$^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1$^{st}$ nucleotide from the 5'-end, or optionally, the count starting at the 1$^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the disclosure may comprise a sense strand and an antisense strand, each strand having 14 to 30 nucleotides, the RNAi duplex represented by formula (III):

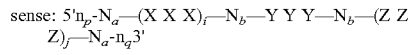

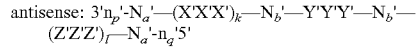 (III)

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides; wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

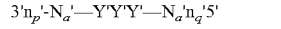 (IIIa)

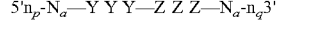

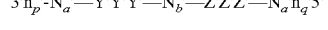 (IIIb)

5'$n_p$-$N_a$—X X X—$N_b$—Y Y Y—$N_a$-$n_q$3'

3'$n_p'$-$N_a'$—X'X'X'—$N_b'$—Y'Y'Y'—$N_a'$-$n_q'$5' (IIIc)

$$5'n_p\text{-}N_a\text{—}X\,X\,X\text{—}N_b\text{—}Y\,Y\,Y\text{—}N_b\text{—}Z\,Z\,Z\text{—}N_a\text{-}n_q3'$$

$$3'n_p'\text{-}N_a'\text{—}X'X'X'\text{—}N_b'\text{—}Y'Y'Y'\text{—}N_b\text{—}Z'Z'Z'\text{—}N_a\text{-}n_q'5' \quad \text{(IIId)}$$

When the RNAi agent is represented by formula (IIIa), each $N_a$ independently represents an oligonucleotide sequence comprising 2-20, 2-15, or 2-10 modified nucleotides.

When the RNAi agent is represented by formula (Mb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2 or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$ independently comprises modifications of alternating pattern.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more C16 (or related) moieties attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more lipophilic, e.g., C16 (or related) moieties, optionally attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more lipophilic, e.g., C16 (or related) moieties attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the disclosure. Such publications include WO2007/091269, WO2010/141511, WO2007/117686, WO2009/014887, and WO2011/031520; and U.S. Pat. No. 7,858,769, the entire contents of each of which are hereby incorporated herein by reference.

In certain embodiments, the compositions and methods of the disclosure include a vinyl phosphonate (VP) modification of an RNAi agent as described herein. In exemplary embodiments, a vinyl phosphonate of the disclosure has the following structure:

A vinyl phosphonate of the instant disclosure may be attached to either the antisense or the sense strand of a dsRNA of the disclosure. In certain preferred embodiments, a vinyl phosphonate of the instant disclosure is attached to the antisense strand of a dsRNA, optionally at the 5' end of the antisense strand of the dsRNA.

Vinyl phosphate modifications are also contemplated for the compositions and methods of the instant disclosure. An exemplary vinyl phosphate structure is:

E. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand) to reduce or inhibit off-target gene silencing. It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, or preferably positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. The term "thermally destabilizing modification(s)" includes modification(s) that would result with a dsRNA with a lower overall melting temperature (Tm) (preferably a Tm with one, two, three or four degrees lower than the Tm of the dsRNA without having such modification(s). In some embodiments, the thermally destabilizing modification of the duplex is located at position 2, 3, 4, 5 or 9 from the 5'-end of the antisense strand.

The thermally destabilizing modifications can include, but are not limited to, abasic modification; mismatch with the opposing nucleotide in the opposing strand; and sugar modification such as 2'-deoxy modification or acyclic nucleotide, e.g., unlocked nucleic acids (UNA) or glycol nucleic acid (GNA).

Exemplified abasic modifications include, but are not limited to the following:

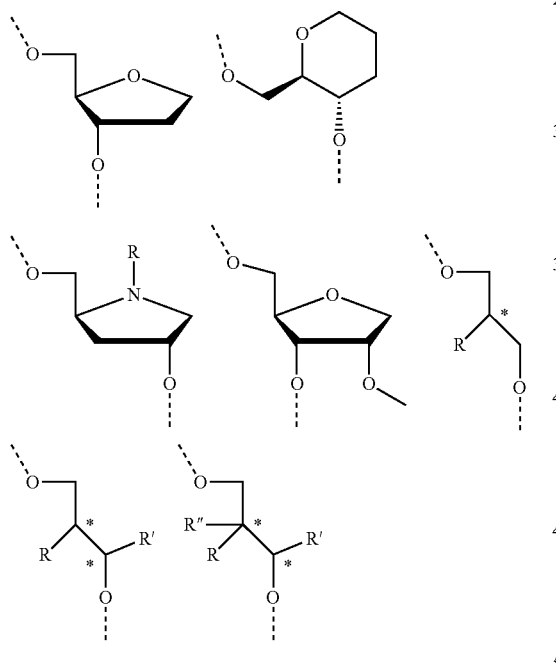

Wherein R=H, Me, Et or OMe; R'=H, Me, Et or OMe; R"=H, Me, Et or OMe

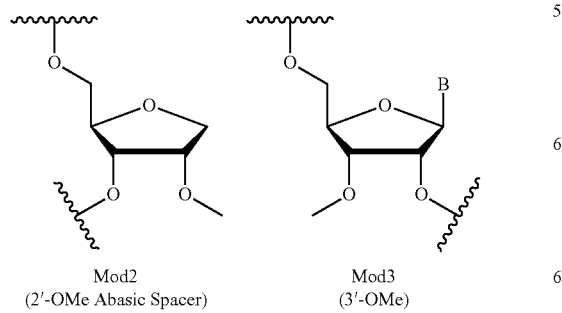

Mod2
(2'-OMe Abasic Spacer)

Mod3
(3'-OMe)

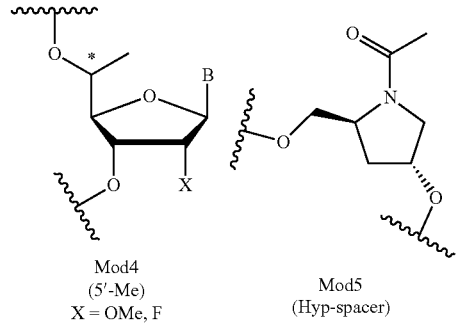

Mod4
(5'-Me)
X = OMe, F

Mod5
(Hyp-spacer)

wherein B is a modified or unmodified nucleobase.

Exemplified sugar modifications include, but are not limited to the following:

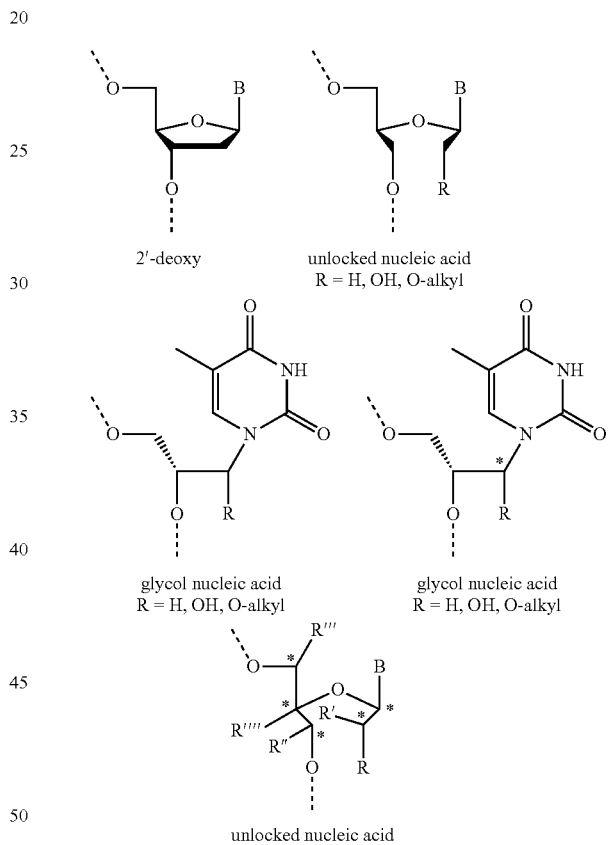

2'-deoxy unlocked nucleic acid
R = H, OH, O-alkyl glycol nucleic acid
R = H, OH, O-alkyl glycol nucleic acid
R = H, OH, O-alkyl unlocked nucleic acid
R = H, OH, CH₃, CH₂CH₃, O-alkyl, NH₂, NHMe, NMe₂
R' = H, OH, CH₃, CH₂CH₃, O-alkyl, NH₂, NHMe, NMe₂
R" = H, OH, CH₃, CH₂CH₃, O-alkyl, NH₂, NHMe, NMe₂
R'" = H, OH, CH₃, CH₂CH₃, O-alkyl, NH₂, NHMe, NMe₂
R"" = H, OH, CH₃, CH₂CH₃, O-alkyl, NH₂, NHMe, NMe₂

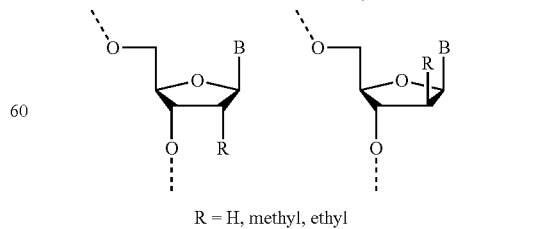

R = H, methyl, ethyl wherein B is a modified or unmodified nucleobase.

In some embodiments the thermally destabilizing modification of the duplex is selected from the group consisting of:

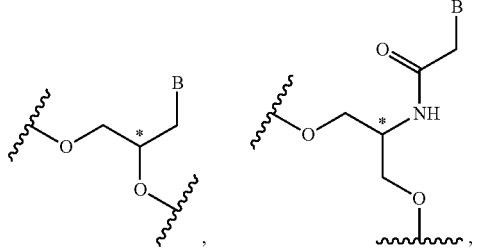

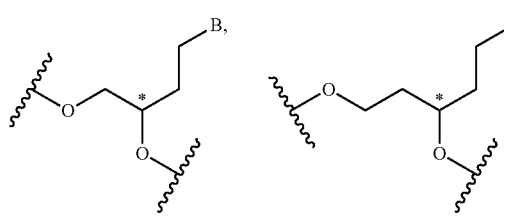

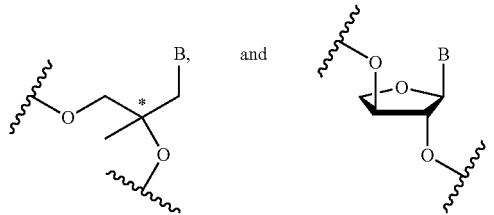

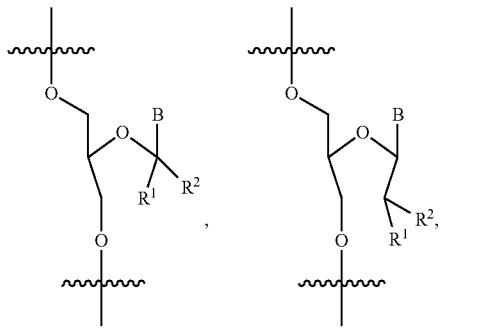

wherein B is a modified or unmodified nucleobase and the asterisk on each structure represents either R, S or racemic.

The term "acyclic nucleotide" refers to any nucleotide having an acyclic ribose sugar, for example, where any of bonds between the ribose carbons (e.g., C1'-C2', C2'-C3', C3'-C4', C4'-O4', or C1'-O4') is absent or at least one of ribose carbons or oxygen (e.g., C1', C2', C3', C4', or O4') are independently or in combination absent from the nucleotide. In some embodiments, acyclic nucleotide

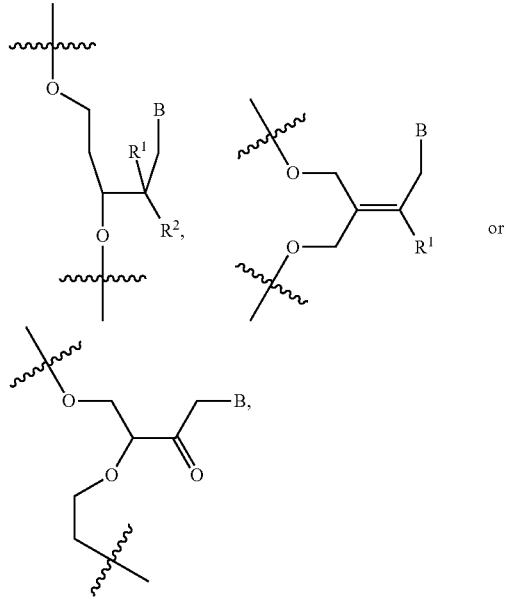

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term "UNA" refers to unlocked acyclic nucleic acid, wherein any of the bonds of the sugar has been removed, forming an unlocked "sugar" residue. In one example, UNA also encompasses monomers with bonds between C1'-C4' being removed (i.e. the covalent carbon-oxygen-carbon bond between the C1' and C4' carbons). In another example, the C2'-C3' bond (i.e. the covalent carbon-carbon bond between the C2' and C3' carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5' or 3'-5' linkage.

The term 'GNA' refers to glycol nucleic acid which is a polymer similar to DNA or RNA but differing in the composition of its "backbone" in that is composed of repeating glycerol units linked by phosphodiester bonds:

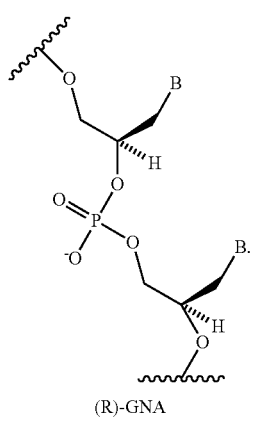

(R)-GNA

The thermally destabilizing modification of the duplex can be mismatches (i.e., noncomplementary base pairs)

between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired W—C H-bonding to complementary base on the target mRNA, such as:

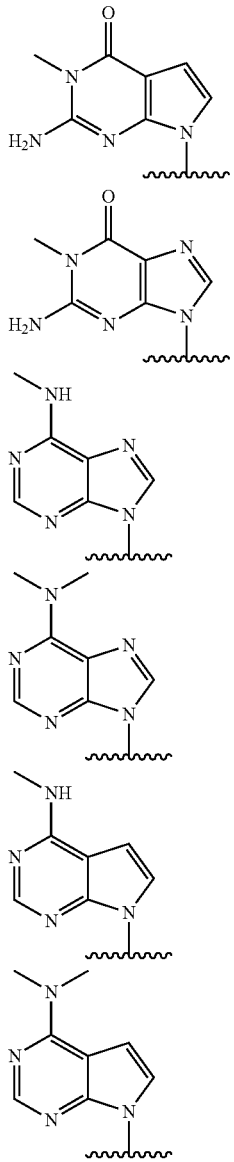

-continued

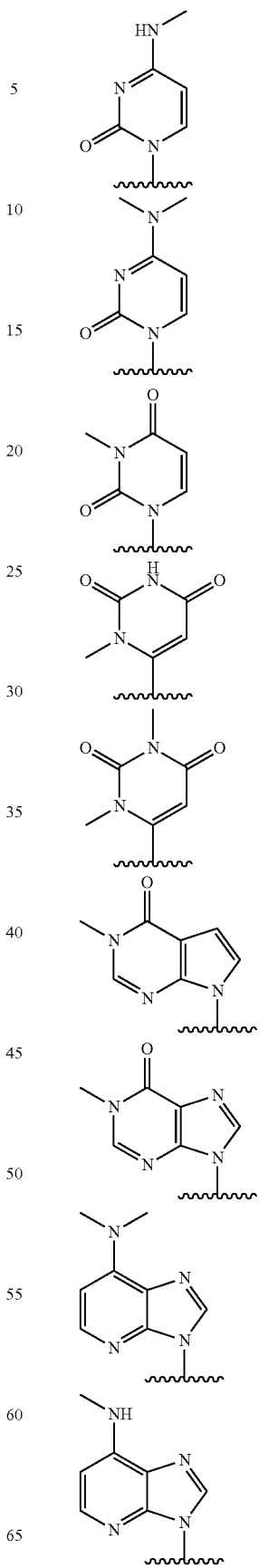

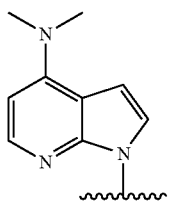

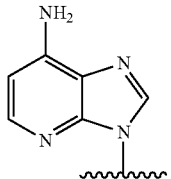

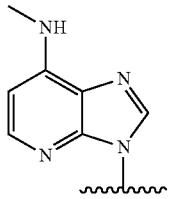

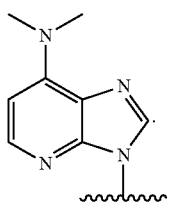

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand. These nucleobase modifications have been evaluated for destabilization of the central region of the dsRNA duplex as described in WO 2010/0011895, which is herein incorporated by reference in its entirety. Exemplary nucleobase modifications are:

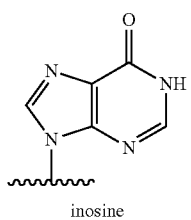
inosine

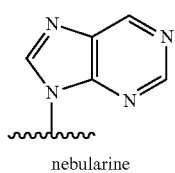
nebularine

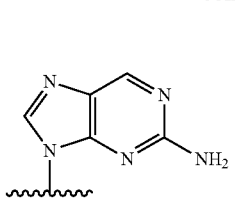
2-aminopurine

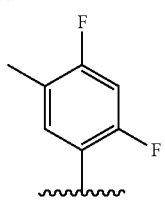
2,4-difluorotoluene

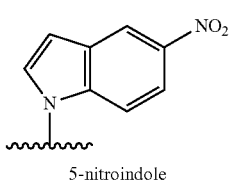
5-nitroindole

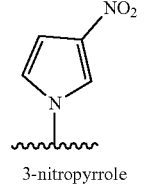
3-nitropyrrole

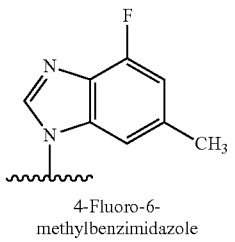
4-Fluoro-6-methylbenzimidazole

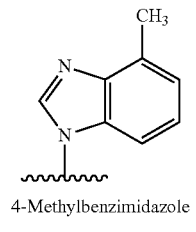
4-Methylbenzimidazole

In some embodiments, the thermally destabilizing modification of the duplex in the seed region of the antisense strand includes one or more α-nucleotide complementary to the base on the target mRNA, such as:

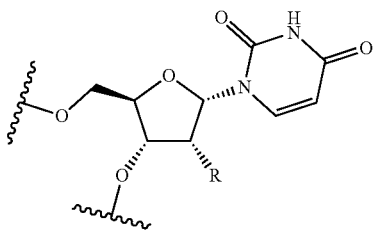

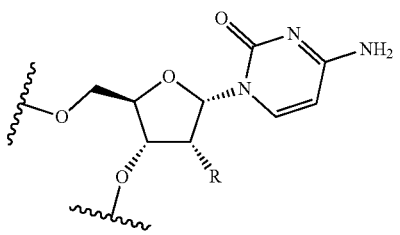

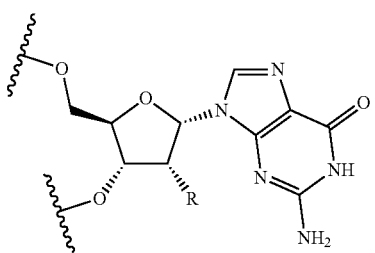

-continued

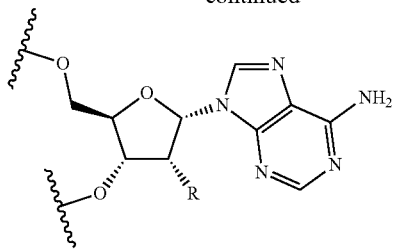

wherein R is H, OH, OCH$_3$, F, NH$_2$, NHMe, NMe$_2$ or O-alkyl.

Exemplary phosphate modifications known to decrease the thermal stability of dsRNA duplexes compared to natural phosphodiester linkages are:

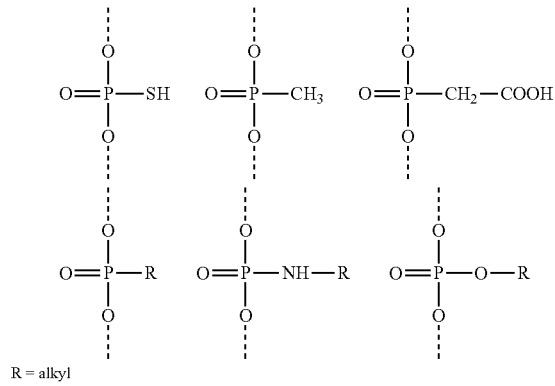

R = alkyl

The alkyl for the R group can be a C$_1$-C$_6$alkyl. Specific alkyls for the R group include, but are not limited to methyl, ethyl, propyl, isopropyl, butyl, pentyl and hexyl.

As the skilled artisan will recognize, in view of the functional role of nucleobases is defining specificity of a RNAi agent of the disclosure, while nucleobase modifications can be performed in the various manners as described herein, e.g., to introduce destabilizing modifications into a RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups or phosphate backbones of polyribonucleotides. Such modifications are described in greater detail in other sections of the instant disclosure and are expressly contemplated for RNAi agents of the disclosure, either possessing native nucleobases or modified nucleobases as described above or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten or more) stabilizing modifications. Without limitations, a stabilizing modification in the antisense strand can be present at any positions. In some embodiments, the antisense comprises stabilizing modifications at positions 2, 6, 8, 9, 14, and 16 from the 5'-end. In some other embodiments, the antisense comprises stabilizing modifications at positions 2, 6, 14, and 16 from the 5'-end. In still some other embodiments, the antisense comprises stabilizing modifications at positions 2, 14, and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10, and 11 from the 5'-end. In some other embodiments, the sense strand comprises stabilizing modifications at positions 7, 9, 10, and 11 from the 5'-end. In some embodiments, the sense strand comprises stabilizing modifications at positions opposite or complimentary to positions 11, 12, and 15 of the antisense strand, counting from the 5'-end of the antisense strand. In some other embodiments, the sense strand comprises stabilizing modifications at positions opposite or complimentary to positions 11, 12, 13, and 15 of the antisense strand, counting from the 5'-end of the antisense strand. In some embodiments, the sense strand comprises a block of two, three, or four stabilizing modifications.

In some embodiments, the sense strand does not comprise a stabilizing modification in position opposite or complimentary to the thermally destabilizing modification of the duplex in the antisense strand.

Exemplary thermally stabilizing modifications include, but are not limited to, 2'-fluoro modifications. Other thermally stabilizing modifications include, but are not limited to, LNA.

In some embodiments, the dsRNA of the disclosure comprises at least four (e.g., four, five, six, seven, eight, nine, ten, or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten, or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14, and 16 from the 5'-end. In some other embodiments, the antisense comprises 2'-fluoro nucleotides at positions 2, 6, 14, and 16 from the 5'-end. In still some other embodiments, the antisense comprises 2'-fluoro nucleotides at positions 2, 14, and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten, or more) 2'-fluoro nucleotides. Without limitations, a 2'-fluoro modification in the sense strand can be present at any positions. In some embodiments, the antisense comprises 2'-fluoro nucleotides at positions 7, 10, and 11 from the 5'-end. In some other embodiments, the sense strand comprises 2'-fluoro nucleotides at positions 7, 9, 10, and 11 from the 5'-end. In some embodiments, the sense strand comprises 2'-fluoro nucleotides at positions opposite or complimentary to positions 11, 12, and 15 of the antisense strand, counting from the 5'-end of the antisense strand. In some other embodiments, the sense strand comprises 2'-fluoro nucleotides at positions opposite or complimentary to positions 11, 12, 13, and 15 of the antisense strand, counting from the 5'-end of the antisense strand. In some embodiments, the sense strand comprises a block of two, three or four 2'-fluoro nucleotides.

In some embodiments, the sense strand does not comprise a 2'-fluoro nucleotide in position opposite or complimentary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a 2 nt overhang, and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; (vi) the dsRNA comprises at least four 2'-fluoro modifications; and (vii) the dsRNA comprises a blunt end at 5'-end of the antisense strand. Preferably, the 2 nt overhang is at the 3'-end of the antisense.

In some embodiments, the dsRNA molecule of the disclosure comprising a sense and antisense strands, wherein: the sense strand is 25-30 nucleotide residues in length, wherein starting from the 5' terminal nucleotide (position 1), positions 1 to 23 of said sense strand comprise at least 8 ribonucleotides; antisense strand is 36-66 nucleotide residues in length and, starting from the 3' terminal nucleotide, at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when said double stranded nucleic acid is introduced into a mammalian cell; and wherein the antisense strand contains at least one thermally destabilizing nucleotide, where at least one thermally destabilizing nucleotide is in the seed region of the antisense strand (i.e. at position 2-9 of the 5'-end of the antisense strand). For example, the thermally destabilizing nucleotide occurs between positions opposite or complimentary to positions 14-17 of the 5'-end of the sense strand, and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA comprises a duplex region of 12-30 nucleotide pairs in length.

In some embodiments, the dsRNA molecule of the disclosure comprises a sense and antisense strands, wherein said dsRNA molecule comprises a sense strand having a length which is at least 25 and at most 29 nucleotides and an antisense strand having a length which is at most 30 nucleotides with the sense strand comprises a modified nucleotide that is susceptible to enzymatic degradation at position 11 from the 5'end, wherein the 3' end of said sense strand and the 5' end of said antisense strand form a blunt end and said antisense strand is 1-4 nucleotides longer at its 3' end than the sense strand, wherein the duplex region which is at least 25 nucleotides in length, and said antisense strand is sufficiently complementary to a target mRNA along at least 19 nt of said antisense strand length to reduce target gene expression when said dsRNA molecule is introduced into a mammalian cell, and wherein dicer cleavage of said dsRNA preferentially results in an siRNA comprising said 3' end of said antisense strand, thereby reducing expression of the target gene in the mammal, wherein the antisense strand contains at least one thermally destabilizing nucleotide, where the at least one thermally destabilizing nucleotide is in the seed region of the antisense strand (i.e. at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA has a duplex region of 12-29 nucleotide pairs in length.

In some embodiments, every nucleotide in the sense strand and antisense strand of the dsRNA molecule may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking 0 of a phosphate moiety. In some cases, the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. e.g., a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, HNA, CeNA, 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independently modified with 2'-O-methyl or 2'-fluoro. It is to be understood that these modifications are in addition to the at least one thermally destabilizing modification of the duplex present in the antisense strand.

At least two different modifications are typically present on the sense strand and antisense strand. Those two modifications may be the 2'-deoxy, 2'-O-methyl or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2'-O-methyl nucleotide, 2'-deoxy nucleotide, 2'-deoxy-2'-fluoro nucleotide, 2'-O-N-methylacetamido (2'-O-NMA) nucleotide, a 2'-O-dimethylaminoethoxyethyl (2'-O-DMAEOE) nucleotide, 2' aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern, particular in the B1, B2, B3, B1', B2', B3', B4' regions. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAAB-BAABB . . . ," "AABAABAABAAB . . . ," "AAABAAA-BAAAB . . . ," "AAABBBAAABBB . . . ," or "ABCAB-CABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region.

For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. Preferably, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13, or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11, or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9, or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7, or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5, or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3, or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within 1-10 of the termini position(s) of the sense or antisense strand. For example, at least 2, 3, 4, 5, 6, 7, 8, 9, or 10 nucleotides may be linked through phosphorothioate or methylphosphonate internucleotide linkage at one end or both ends of the sense or antisense strand.

In some embodiments, the dsRNA molecule of the disclosure further comprises one or more phosphorothioate or methylphosphonate internucleotide linkage modification within 1-10 of the internal region of the duplex of each of the sense or antisense strand. For example, at least 2, 3, 4, 5, 6, 7, 8, 9, or 10 nucleotides may be linked through phosphorothioate methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, compound of the disclosure comprises a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, compound of the disclosure comprises a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, compound of the disclosure comprises a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the antisense strand comprises phosphorothioate internucleotide linkages between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the antisense comprises 3, 4, or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4, or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the sense strand is conjugated with a ligand; (iii) the sense strand comprises 2, 3, 4 or 5 2'-fluoro modifications; (iv) the sense strand comprises 1, 2, 3, 4, or 5 phosphorothioate internucleotide linkages; (v) the dsRNA comprises at least four 2'-fluoro modifications; (vi) the dsRNA comprises a duplex region of 12-40 nucleotide pairs in length; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4 or 5 2'-fluoro modifications; (v) the sense strand comprises 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 3, 4 or 5 phosphorothioate internucleotide linkages; (v) the dsRNA comprises at least four 2'-fluoro modifications; (vi) the dsRNA comprises a duplex region of 12-40 nucleotide pairs in length; and (vii) the dsRNA has a blunt end at 5'-end of the antisense strand.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA molecule of the disclosure comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified or 5'-modified nucleotide to the 3'-end of a phosphodiester (PO), phosphorothioate (PS), or phosphorodithioate (PS2) linkage of a dinucleotide at any position of single stranded or double stranded oligonucleotide can exert steric effect to the internucleotide linkage and, hence, protecting or stabilizing it against nucleases.

In some embodiments, 5'-modified nucleoside is introduced at the 3'-end of a dinucleotide at any position of single stranded or double stranded siRNA. For instance, a 5'-alkylated nucleoside may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleoside is 5'-methyl nucleoside. The 5'-methyl can be either racemic or chirally pure R or S isomer.

In some embodiments, 4'-modified nucleoside is introduced at the 3'-end of a dinucleotide at any position of single stranded or double stranded siRNA. For instance, a 4'-alkylated nucleoside may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleoside is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleoside is 4'-O-methyl nucleoside. The 4'-O-methyl can be either racemic or chirally pure R or S isomer.

In some embodiments, 5'-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleoside is 5'-methyl nucleoside. The 5'-methyl can be either racemic or chirally pure R or S isomer.

In some embodiments, 4'-alkylated nucleoside is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleoside is 4'-methyl nucleoside. The 4'-methyl can be either racemic or chirally pure R or S isomer.

In some embodiments, 4'-O-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleoside is 4'-O-methyl nucleoside. The 4'-O-methyl can be either racemic or chirally pure R or S isomer.

In some embodiments, the dsRNA molecule of the disclosure can comprise 2'-5' linkages (with 2'-H, 2'-OH and 2'-OMe and with P=O or P=S). For example, the 2'-5' linkages modifications can be used to promote nuclease resistance or to inhibit binding of the sense to the antisense strand, or can be used at the 5' end of the sense strand to avoid sense strand activation by RISC.

In another embodiment, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

Various publications describe multimeric siRNA which can all be used with the dsRNA of the disclosure. Such publications include WO2007/091269, U.S. Pat. No. 7,858, 769, WO2010/141511, WO2007/117686, WO2009/014887, and WO2011/031520 which are hereby incorporated by their entirely.

As described in more detail below, the RNAi agent that contains conjugations of one or more carbohydrate moieties to an RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the disclosure is an agent selected from the group of agents listed in any one of Tables 2 and 3. These agents may further comprise a ligand, such as one or more lipophilic moieties, one or more GalNAc derivatives, or both of one of more lipophilic moieties and one or more GalNAc derivatives.

IV. iRNAs Conjugated to Ligands

Another modification of the RNA of an iRNA of the invention involves chemically linking to the iRNA one or more ligands, moieties or conjugates that enhance the activity, cellular distribution or cellular uptake of the iRNA, e.g., into a cell. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides alkyl & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In certain embodiments, a ligand alters the distribution, targeting or lifetime of an iRNA agent into which it is incorporated. In some embodiments, a ligand provides an enhanced affinity for a selected target, e.g., molecule, cell or cell type, compartment, e.g., a cellular or organ compartment, tissue, organ or region of the body, as, e.g., compared to a species absent such a ligand. Typical ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an a helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule can typically bind a serum protein, such as human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid-based ligand can be used to modulate, e.g., control (e.g., inhibit) the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid-based ligand binds HSA. For example, the ligand can bind HSA with a sufficient affinity such that distribution of the conjugate to a non-kidney tissue is enhanced. However, the affinity is typically not so strong that the HSA-ligand binding cannot be reversed.

In certain embodiments, the lipid-based ligand binds HSA weakly or not at all, such that distribution of the conjugate to the kidney is enhanced. Other moieties that target to kidney cells can also be used in place of or in addition to the lipid-based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

B. Cell Permeation Agents

In another aspect, the ligand is a cell-permeation agent, such as a helical cell-permeation agent. In certain embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is typically an α-helical agent and can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:11). An RFGF analogue (e g, amino acid sequence AALLPVLLAAP (SEQ ID NO:12)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:13)) and the Drosophila Antennapedia protein (RQIKIWFQNRRMKWKK (SEQ ID NO:14)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature*, 354:82-84, 1991). Typically, the peptide or peptidomimetic tethered to a dsRNA agent via an incorporated monomer unit is a cell targeting peptide such as an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

An RGD peptide moiety can be used to target a particular cell type, e.g., a tumor cell, such as an endothelial tumor cell or a breast cancer tumor cell (Zitzmann et al., *Cancer Res.*, 62:5139-43, 2002). An RGD peptide can facilitate targeting of an dsRNA agent to tumors of a variety of other tissues, including the lung, kidney, spleen, or liver (Aoki et al., *Cancer Gene Therapy* 8:783-787, 2001). Typically, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha_v\beta_3$ (Haubner et al., *Jour. Nucl. Med.*, 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., *Nucl. Acids Res.* 31:2717-2724, 2003).

C. Carbohydrate Conjugates

In some embodiments of the compositions and methods of the invention, an iRNA further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and tri-saccharides include sugars having two or three monosaccharide units (e.g., C5, C6, C7, or C8).

In certain embodiments, a carbohydrate conjugate comprises a monosaccharide.

In certain embodiments, the monosaccharide is an N-acetylgalactosamine (GalNAc). GalNAc conjugates, which comprise one or more N-acetylgalactosamine (Gal-NAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the GalNAc conjugate is

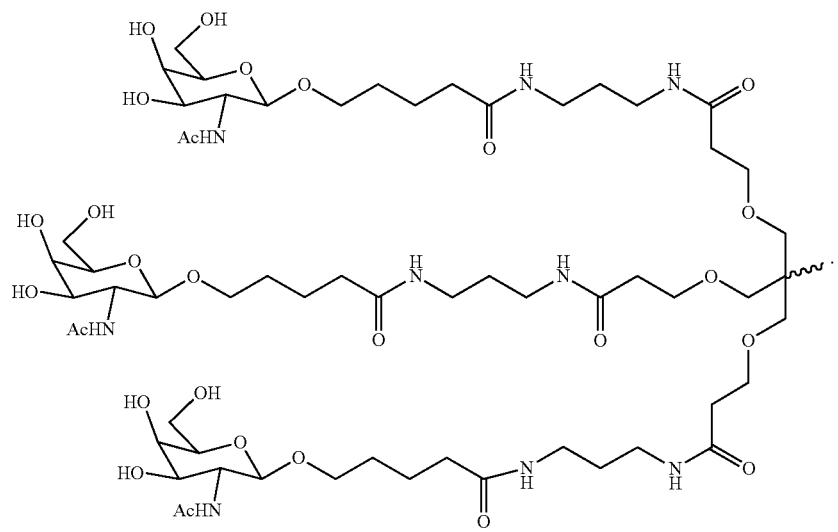

Formula II

In some embodiments, the RNAi agent is attached to the carbohydrate conjugate via a linker as shown in the following schematic, wherein X is O or S

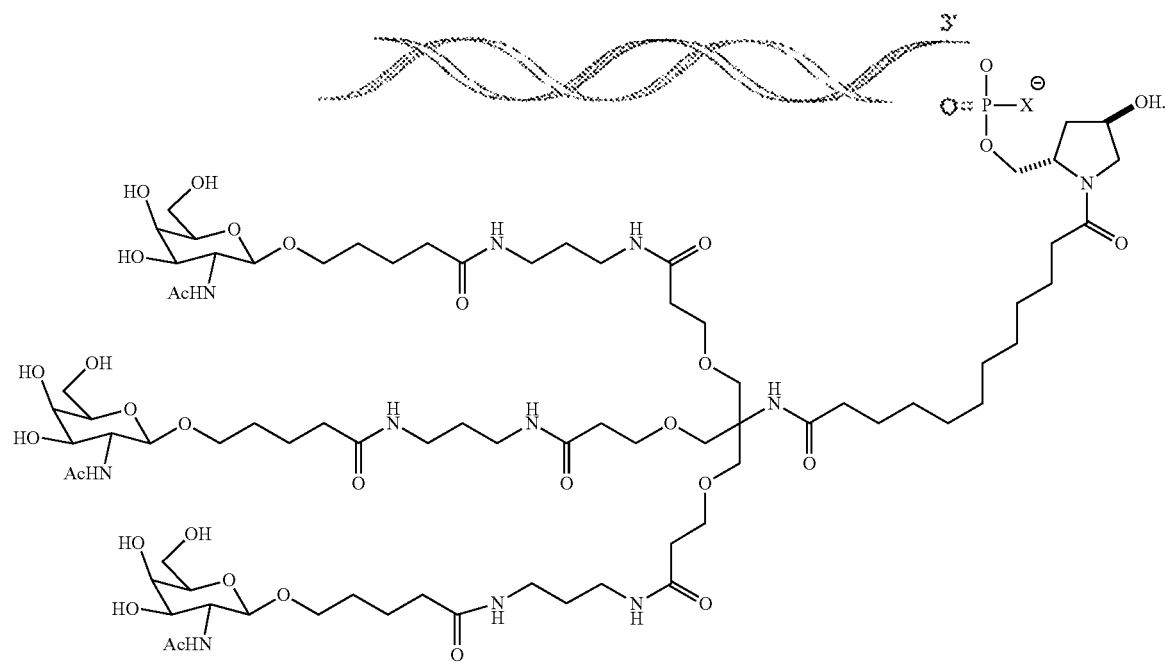

In some embodiments, the RNAi agent is conjugated to L96 as defined in Table 1 and shown below:

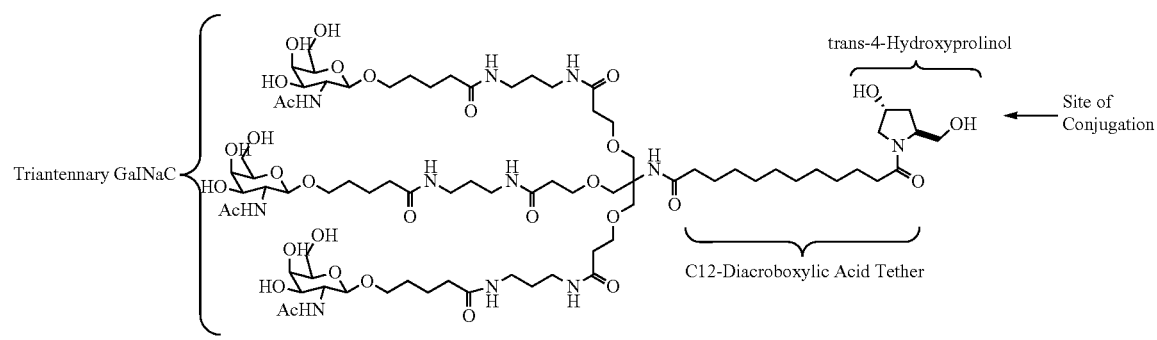

In certain embodiments, a carbohydrate conjugate for use in the compositions and methods of the invention is selected from the group consisting of:

Formula II
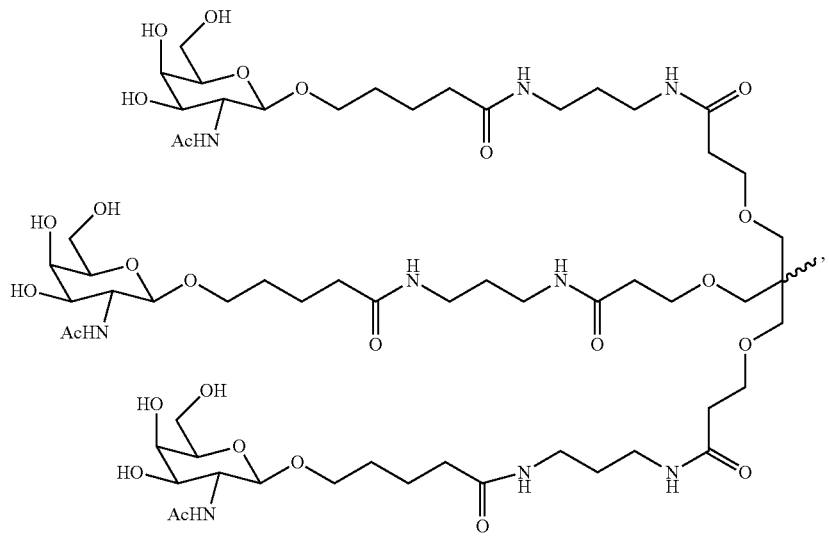
Formula III
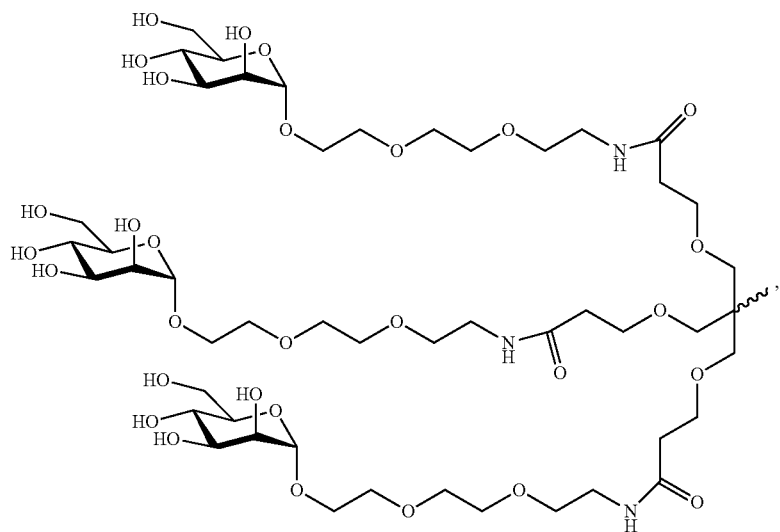
Formula IV
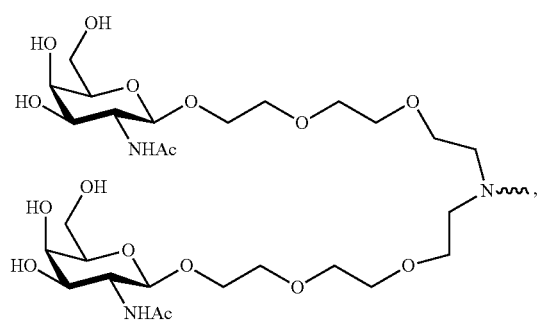
Formula V
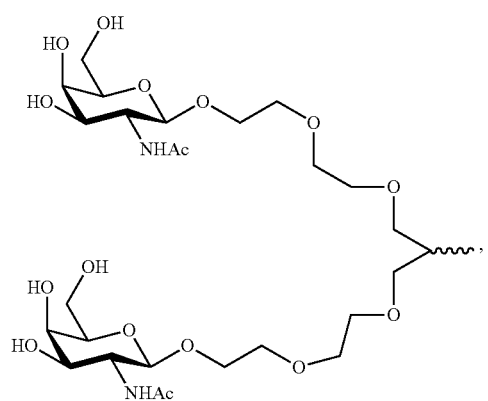

Formula VI
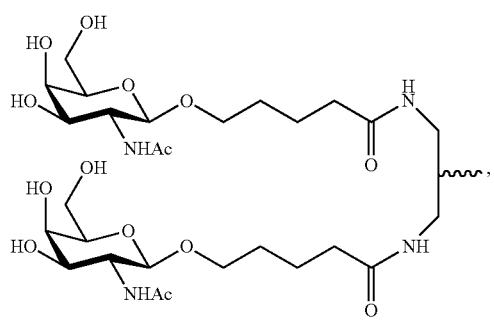
Formula VII
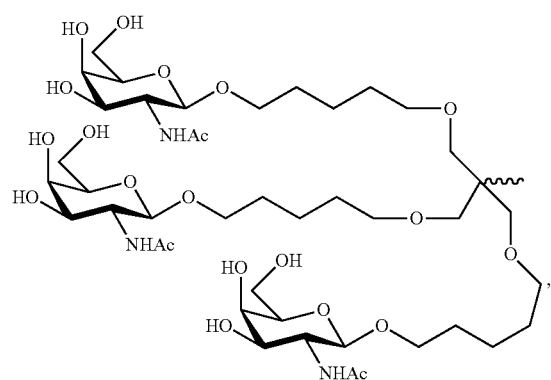
Formula VIII
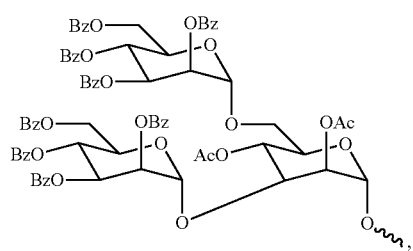
Formula IX
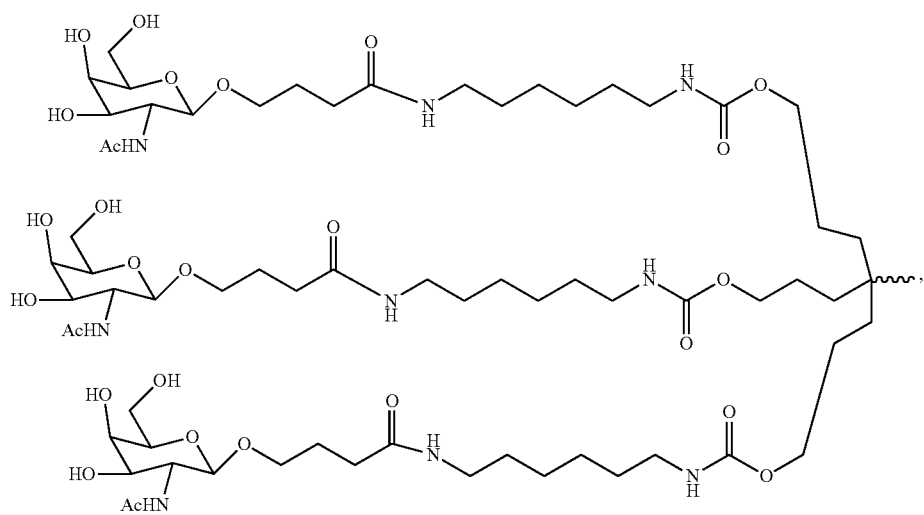
Formula X
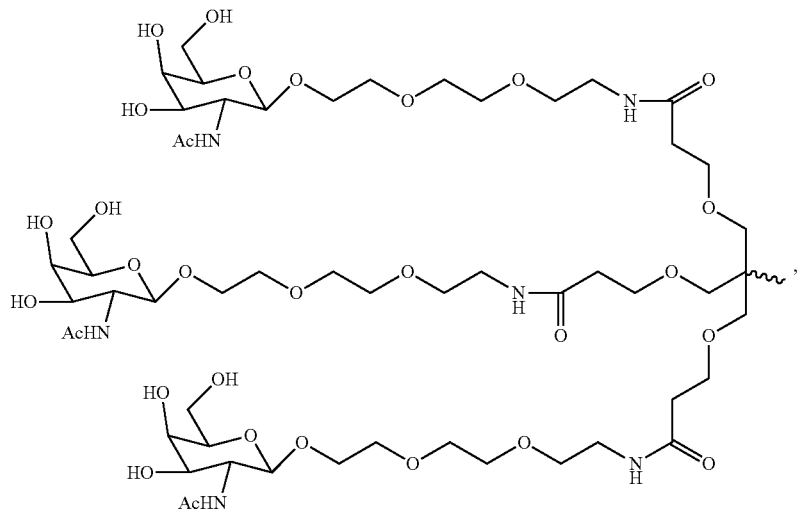

-continued
Formula XI
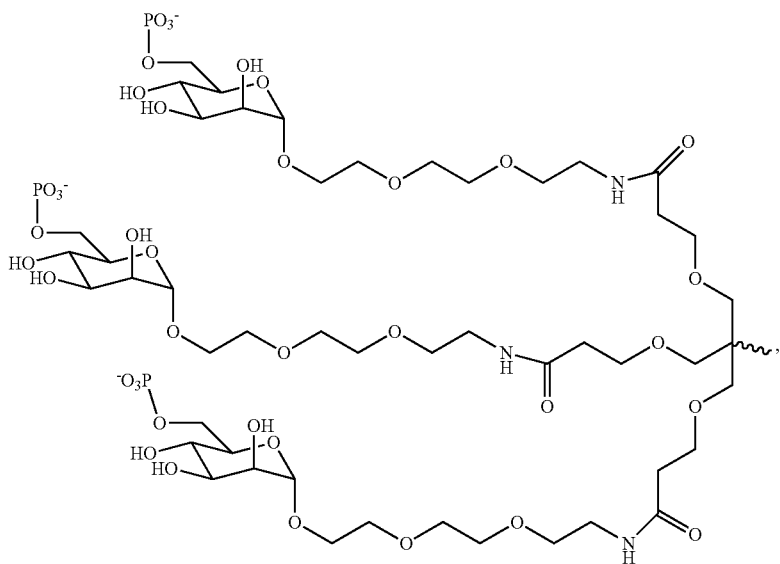
Formula XII
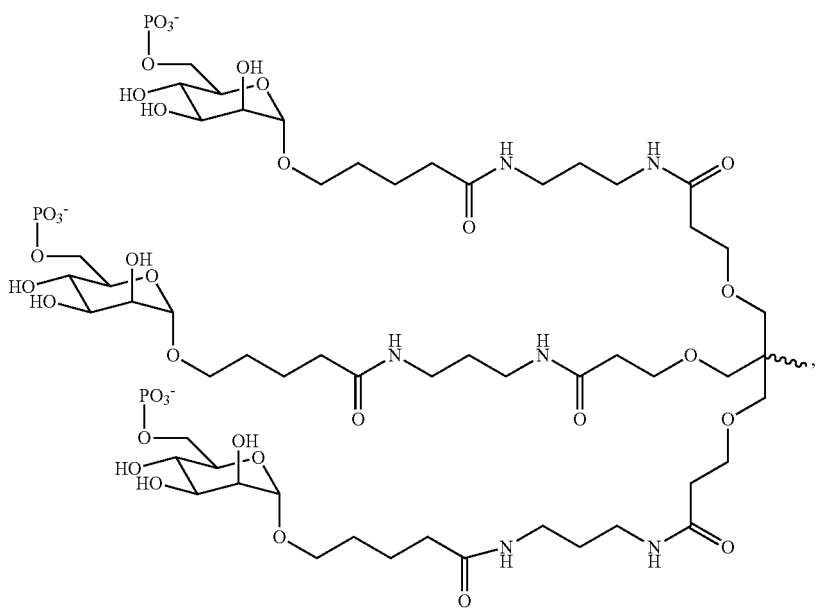
Formula XIII
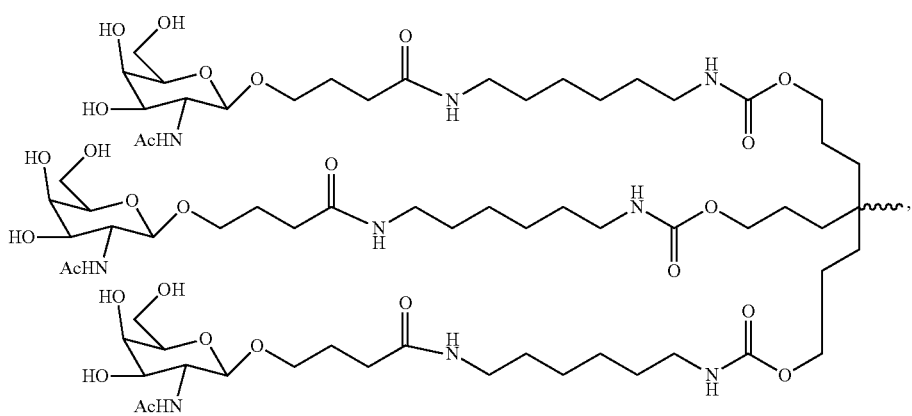

-continued
Formula XIV
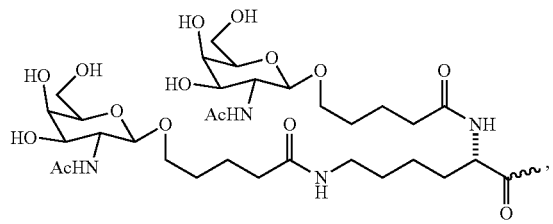,
Formula XV
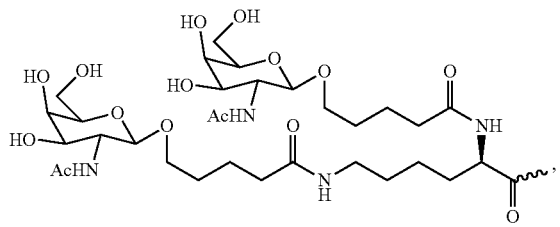,
Formula XVI
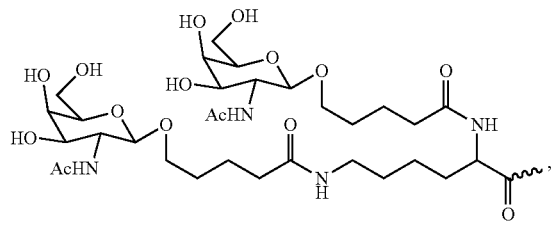,
Formula XVII
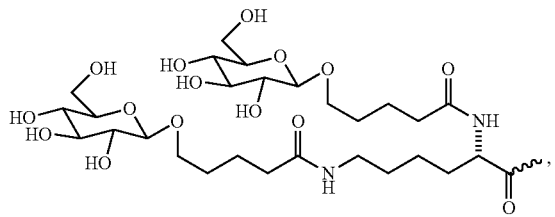,
Formula XVIII
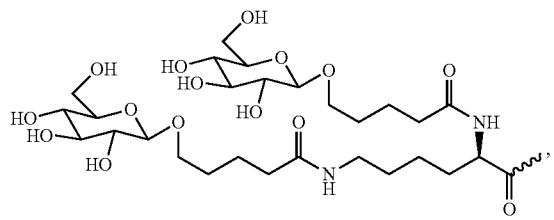,
Formula XIX
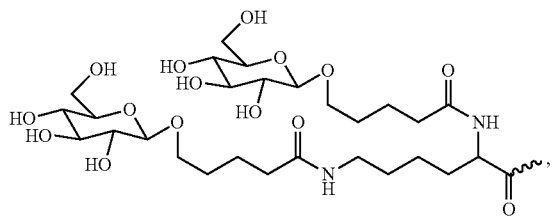,
Formula XX
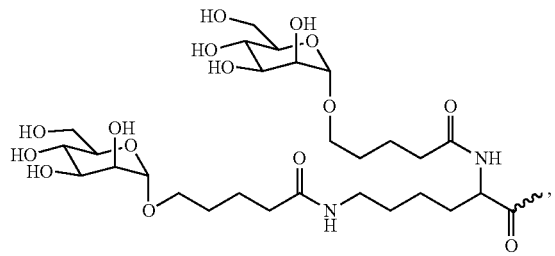,
Formula XXI
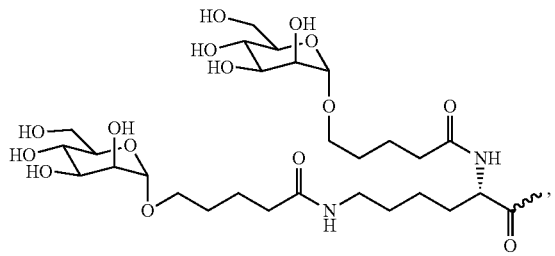,
Formula XXII
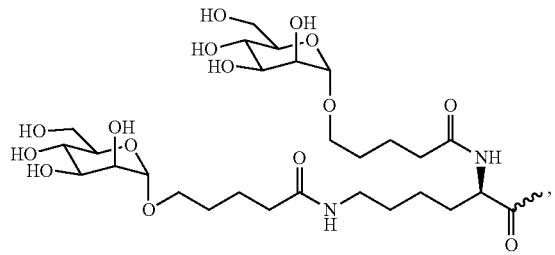,
Formula XXIII
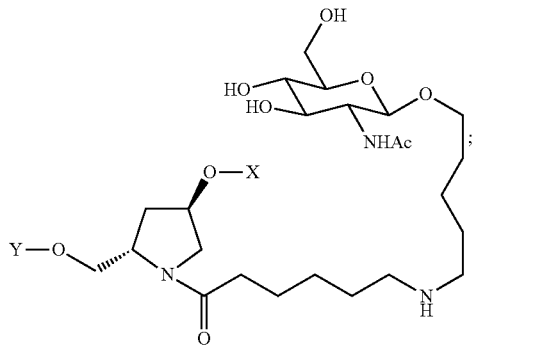

-continued
(Formula XXIV)
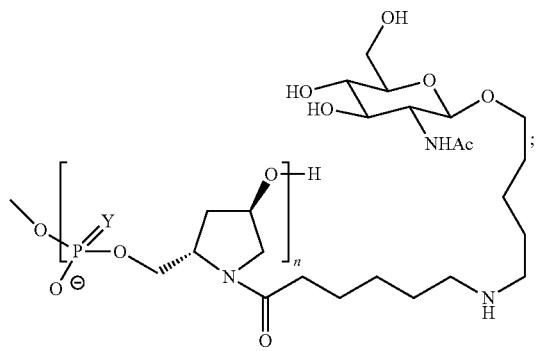
wherein Y is O or S and n is 3-6
(Formula XXV)
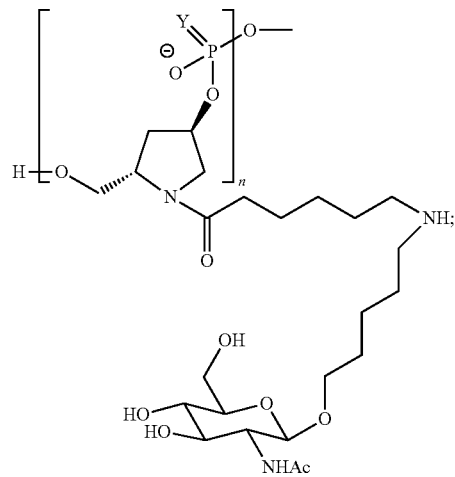
wherein Y is O or S and n is 3-6
Formula XXVI
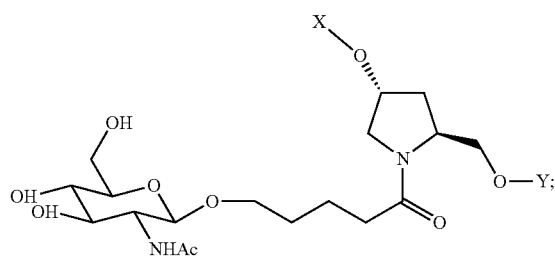
(Formula XXVII)
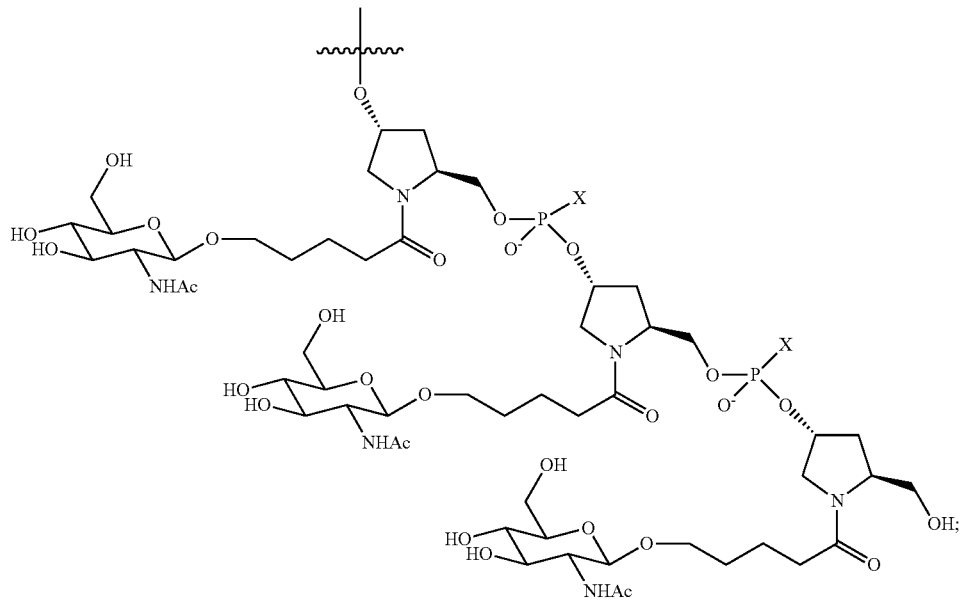
wherein X is O or S Formula XXVII
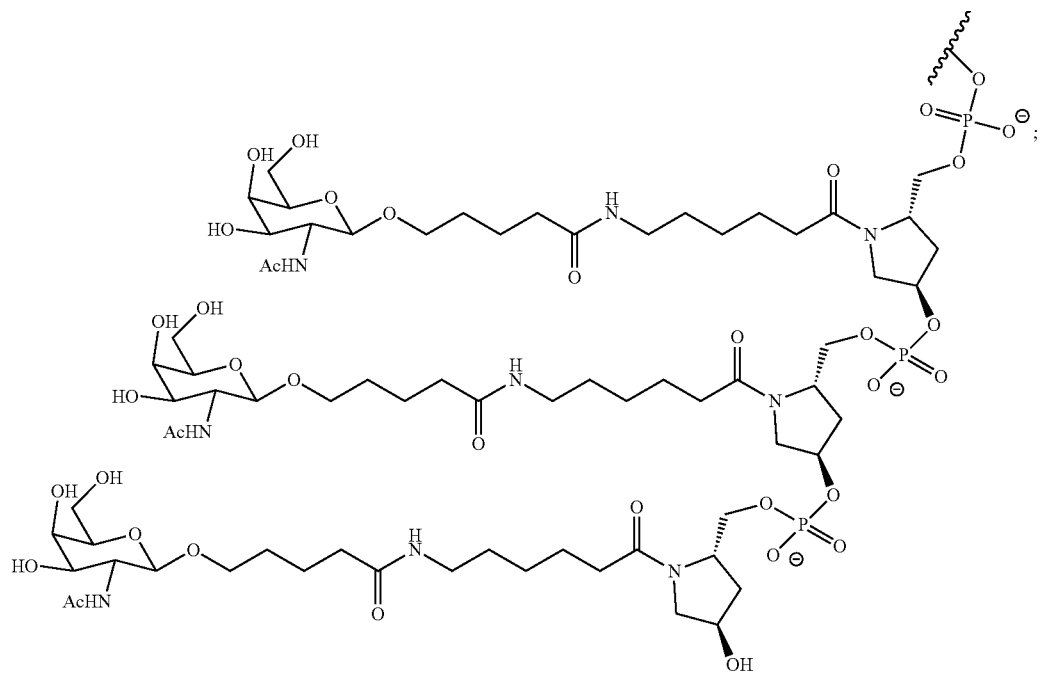
Formula XXIX
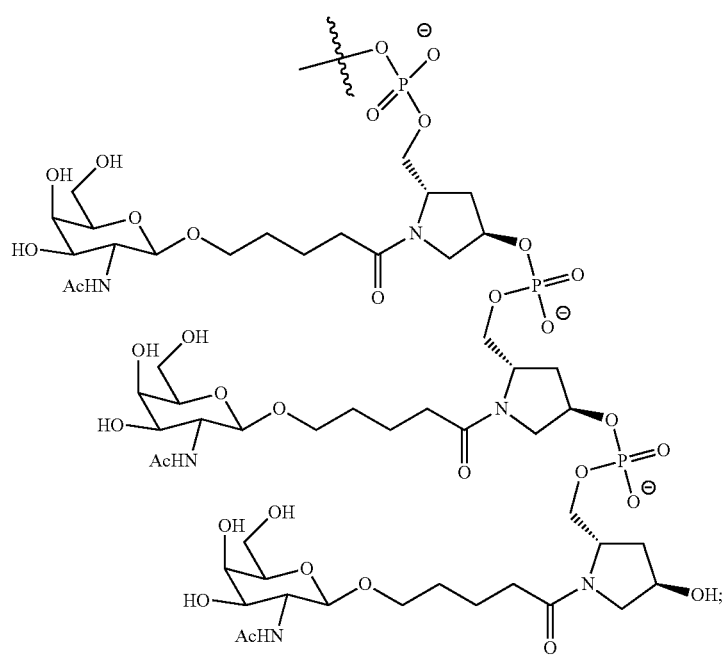

Formula XXX
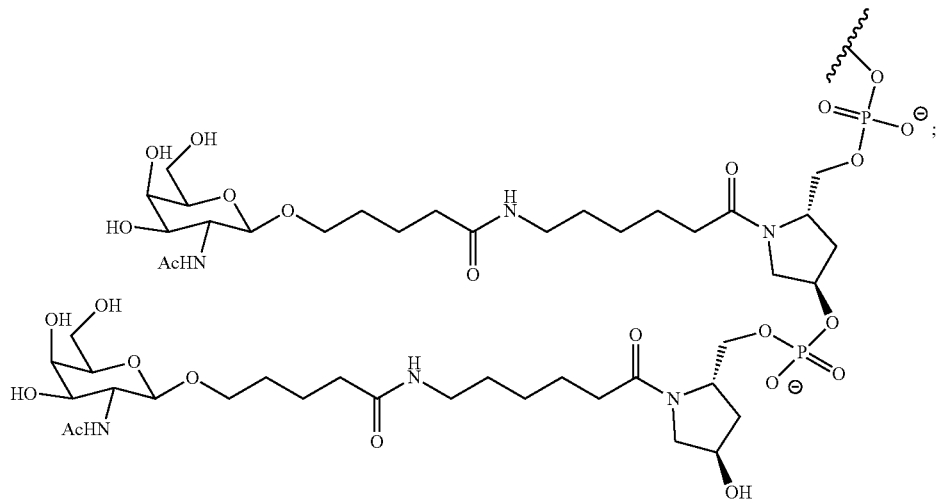
Formula XXXI
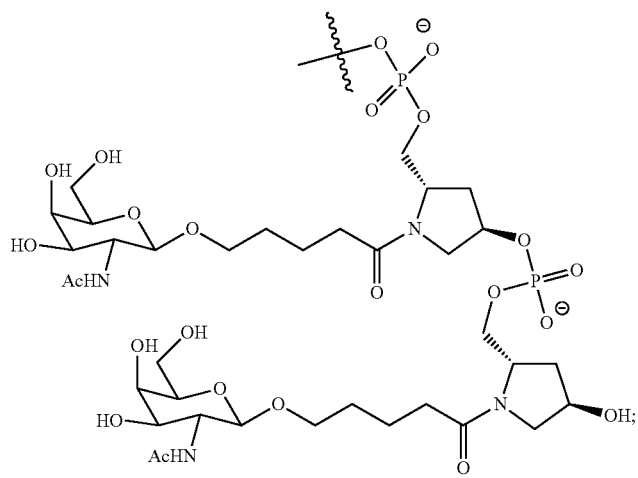
Formula XXXII
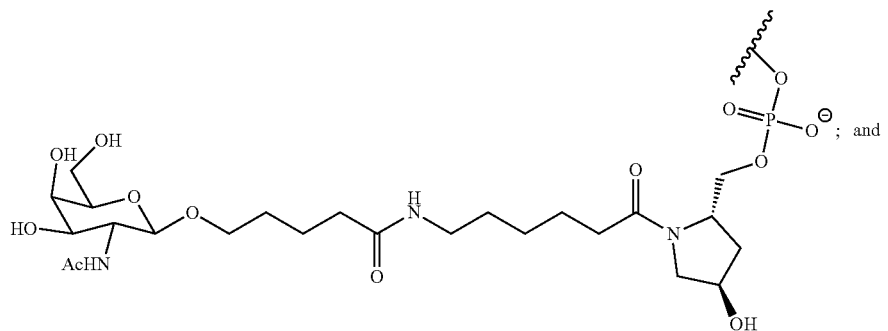
Formula XXXIII
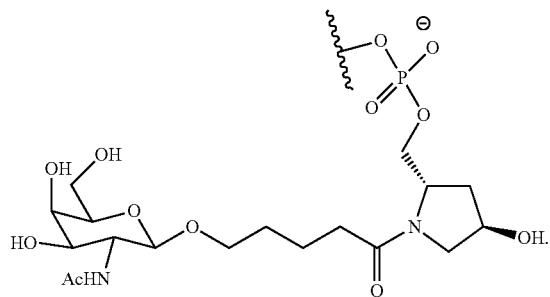

Formula XXXIV
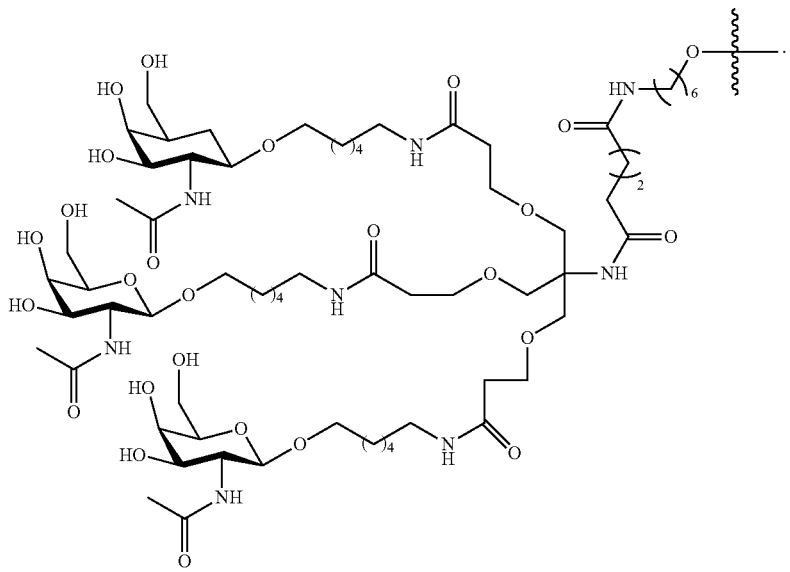
In certain embodiments, a carbohydrate conjugate for use in the compositions and methods of the invention is a monosaccharide. In certain embodiments, the monosaccharide is an N-acetylgalactosamine, such as
Formula II
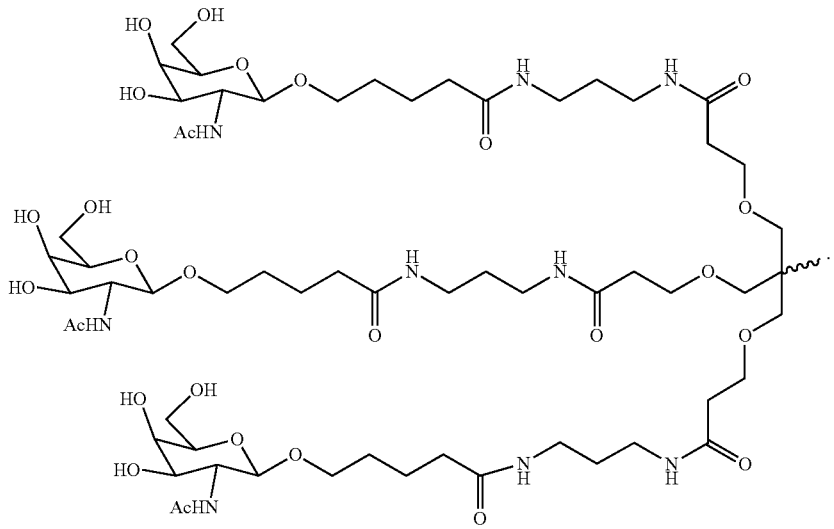
Another representative carbohydrate conjugate for use in the embodiments described herein includes, but is not limited to, (Formula XXXVI)

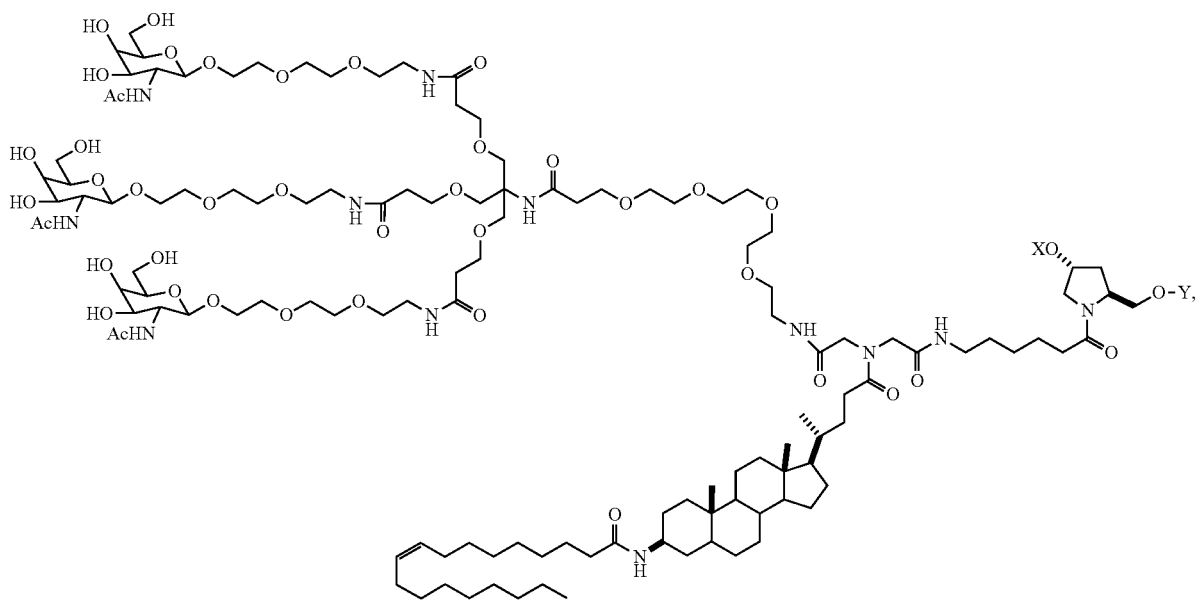

when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

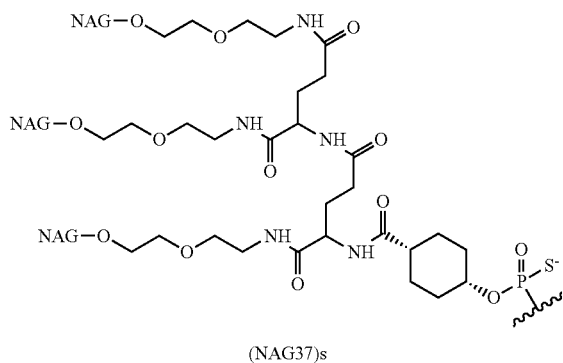

(NAG37)s

In certain embodiments, the RNAi agents of the disclosure may include GalNAc ligands, even if such GalNAc ligands are currently projected to be of limited value for the preferred pulmonary system delivery route(s) of the instant disclosure.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent, e.g., the 5' end of the sense strand of a dsRNA agent, or the 5' end of one or both sense strands of a dual targeting RNAi agent as described herein. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NRB, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), SO$_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In certain embodiments, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In certain embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S) (ORk)-O—, —O—P(S)(SRk)-O—, —S—P(O)(ORk)-O—, —O—P(O)(ORk)-S—, —S—P(P)(ORk)-S—, —O—P(S) (ORk)-S—, —S—P(S)(ORk)-O—, —O—P(O)(Rk)-O—, —O—P(S)(Rk)-O—, —S—P(O)(Rk)-O—, —S—P(S) (Rk)-S—P(O)(Rk)-S—, —O—P(S)(Rk)-S. Preferred embodiments are —O—P(O)(OH)—O—, —O—P(S) (OH)—O—, P(S)(SH)—O—, —S—P(O)(OH)—O—, —O—P(O)(OH)—S—, —S—P(O)(OH)—S—, —O—P(S) (OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In certain embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Cleavable Linking Groups

In certain embodiments, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleavable Linking Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O) NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXXVII)

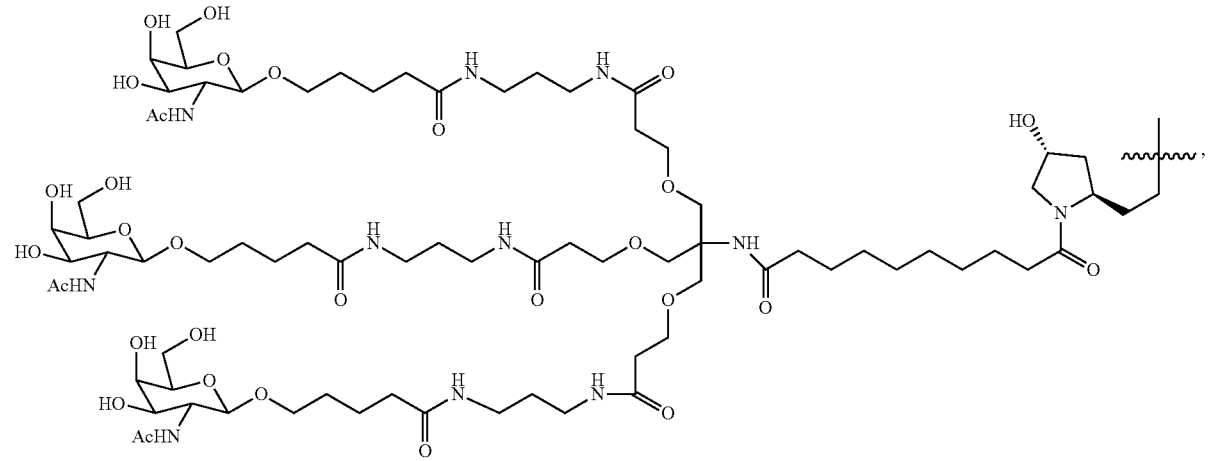

-continued
(Formula XXXVIII)
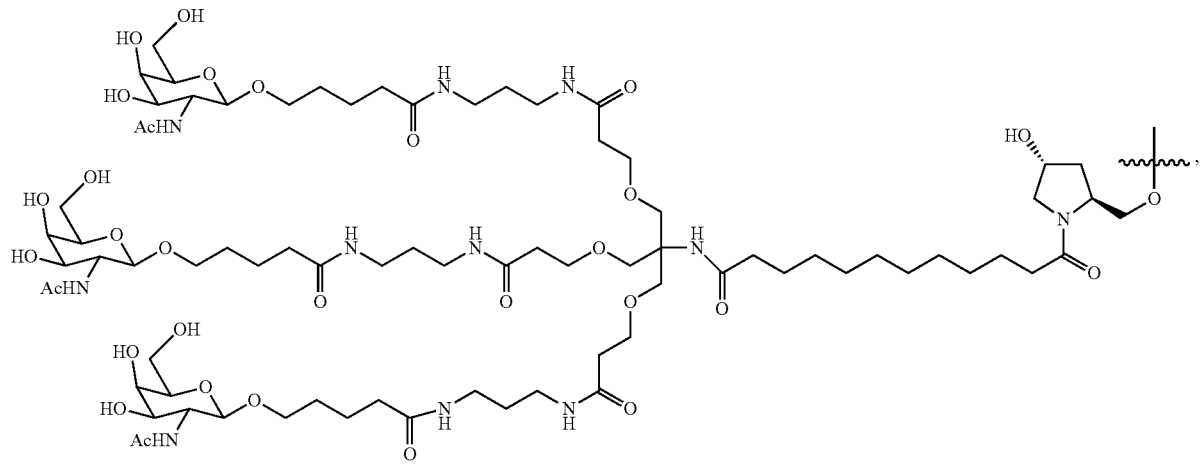
(Formula XXXIX)
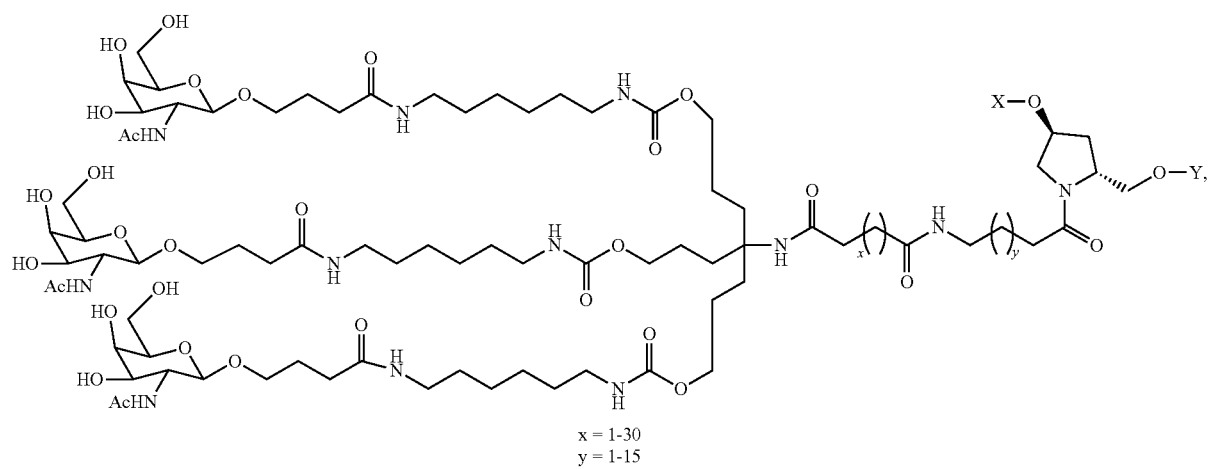
x = 1-30
y = 1-15
(Formula XL)
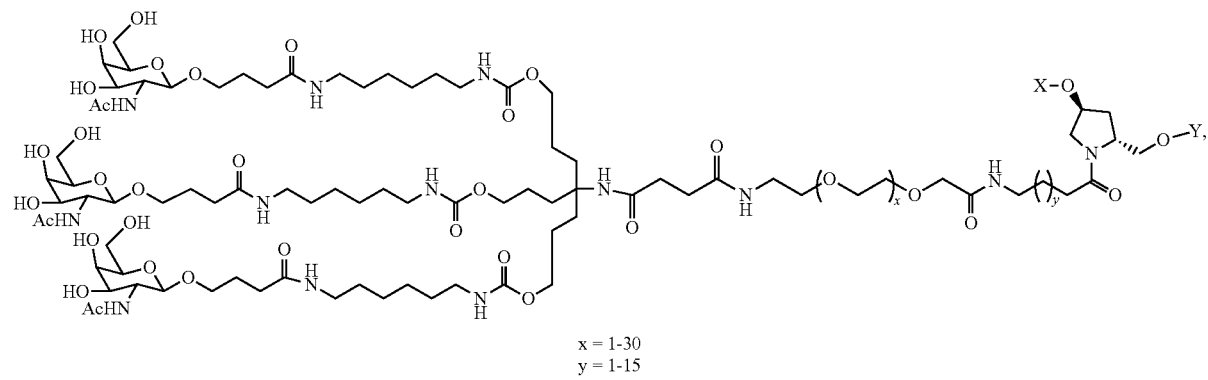
x = 1-30
y = 1-15

(Formula XLI)
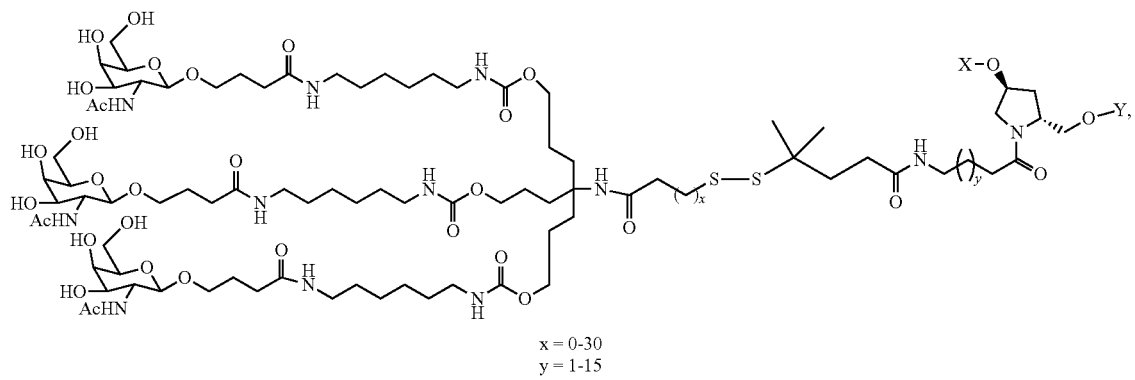
x = 0-30
y = 1-15
(Formula XLII)
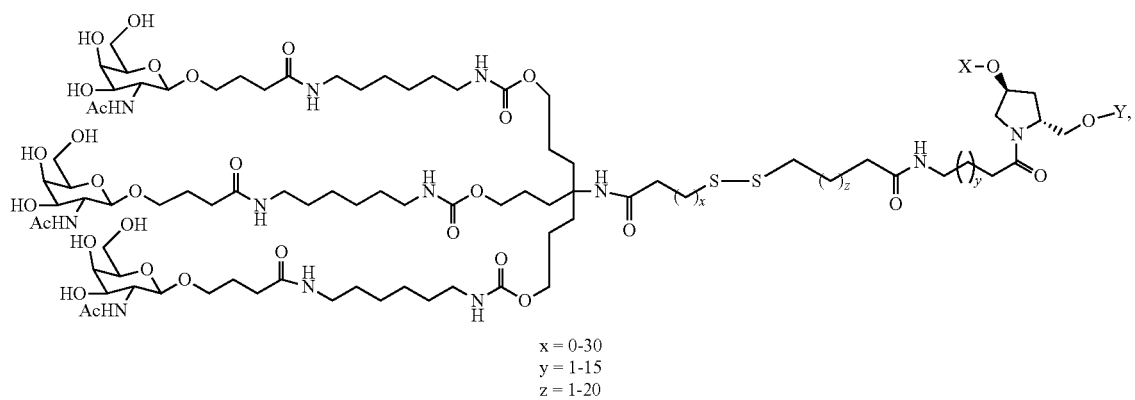
x = 0-30
y = 1-15
z = 1-20
(Formula XLIII)
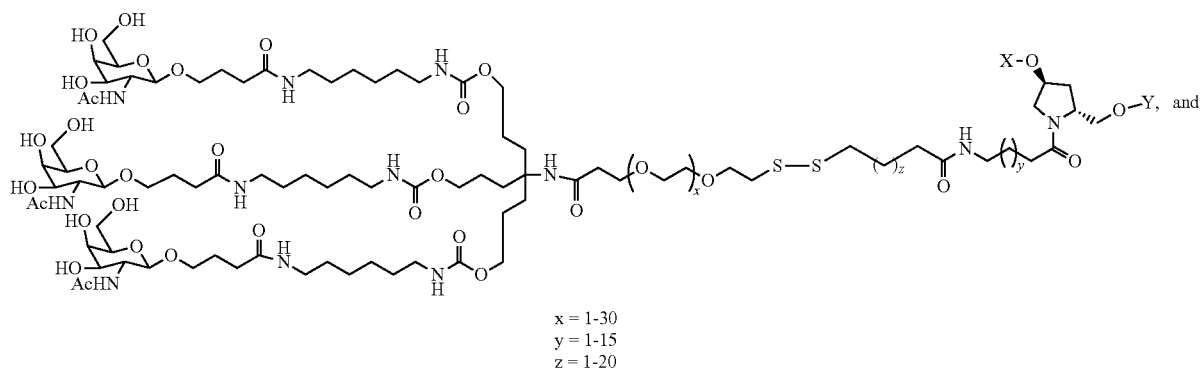
x = 1-30
y = 1-15
z = 1-20
(Formula XLIV)
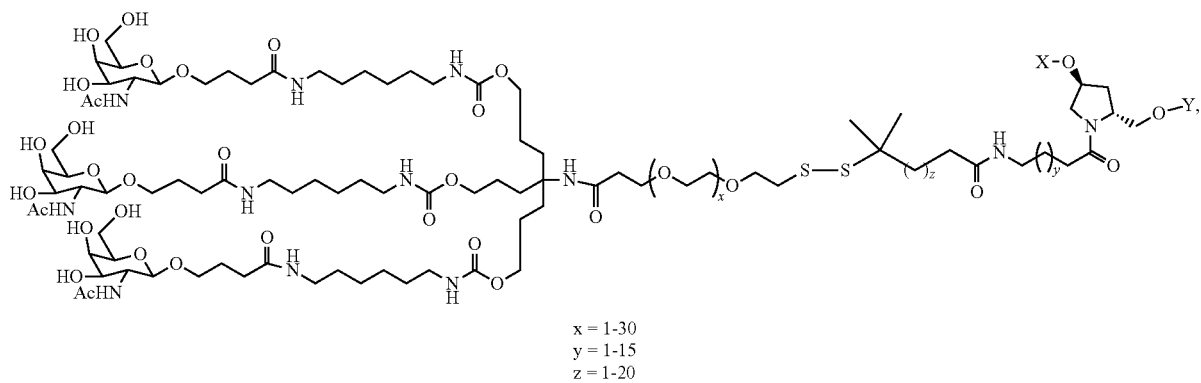
x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In certain embodiments, a dsRNA of the invention is conjugated to a bivalent or trivalent branched linker selected from the group of structures shown in any of formula (XLV)-(XLVI):

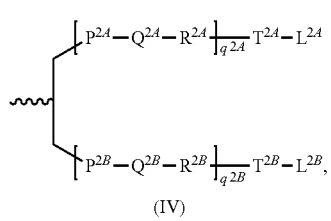

Formula XXXXV (IV)

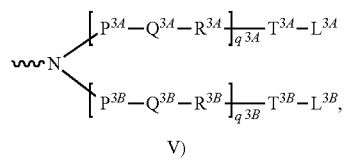

Formula XLVI

V)

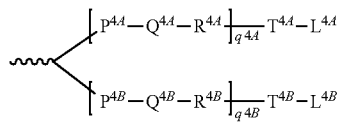

Formula XLVII

Formula XLVIII

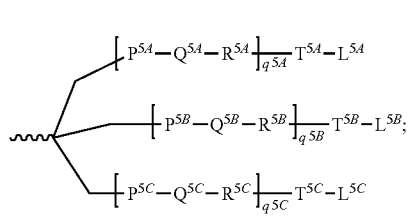

wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC (O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—CH($R^a$)—NH—, CO, CH=N—O,

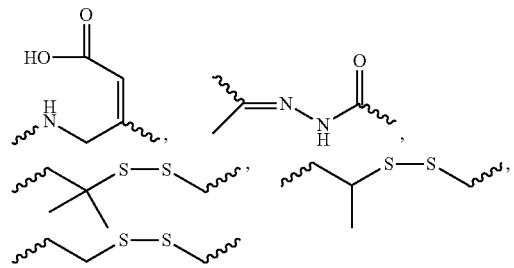

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

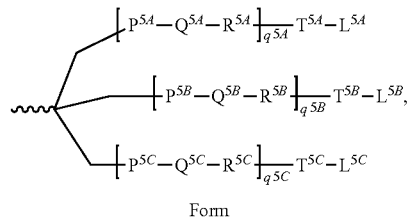

Formula XLIX

Form wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541, 313; 5,545,730; 5,552,538; 5,578,717; 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241; 5,391,723; 5,416,203; 5,451, 463; 5,510,475; 5,512,667; 5,514,785; 5,565,552; 5,567, 810; 5,574,142; 5,585,481; 5,587,371; 5,595,726; 5,597, 696; 5,599,923; 5,599,928; 5,688,941; 6,294,664; 6,320, 017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNA agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an RNAi Agent of the Disclosure

The delivery of a RNAi agent of the disclosure to a cell e.g., a cell within a subject, such as a human subject (e.g., a subject in need thereof, such as a subject having a TMPRSS2-associated disorder, e.g., a coronavirus-associated disorder, e.g., a subject having or at risk of developing of at risk of having a coronavirus infection, e.g., a subject having or at risk of developing or at risk of having Severe Acute Respiratory Syndrome 2 (SARS-CoV-2; COVID-19), Severe Acute Respiratory Syndrome (SARS-CoV), or Middle East Respiratory Syndrome (MERS-CoV)), can be achieved in a number of different ways. For example, delivery may be performed by contacting a cell with an RNAi agent of the disclosure either in vitro or in vivo. In vivo delivery may also be performed directly by administering a composition comprising an RNAi agent, e.g., a dsRNA, to a subject. Alternatively, in vivo delivery may be performed indirectly by administering one or more vectors that encode and direct the expression of the RNAi agent. These alternatives are discussed further below.

In general, any method of delivering a nucleic acid molecule (in vitro or in vivo) can be adapted for use with a RNAi agent of the disclosure (see e.g., Akhtar S. and Julian R L., (1992) *Trends Cell. Biol.* 2(5):139-144 and WO94/02595, which are incorporated herein by reference in their entireties). For in vivo delivery, factors to consider in order to deliver an RNAi agent include, for example, biological stability of the delivered agent, prevention of non-specific effects, and accumulation of the delivered agent in the target tissue. The non-specific effects of an RNAi agent can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the RNAi agent to be administered. Several studies have shown successful knockdown of gene products when an RNAi agent is administered locally. For example, pulmonary delivery, e.g., inhalation, of a dsRNA, e.g., SOD1, has been shown to effectively knockdown gene and protein expression in lung tissue and that there is excellent uptake of the dsRNA by the bronchioles and alveoli of the lung. Intraocular delivery of a VEGF dsRNA by intravitreal injection in cynomolgus monkeys (Tolentino, M I et al., (2004) *Retina* 24:132-138) and subretinal injections in mice (Reich, S J. et al. (2003) *Mol. Vis.* 9:210-216) were also both shown to prevent neovascularization in an experimental model of age-related macular degeneration. In addition, direct intratumoral injection of a dsRNA in mice reduces tumor volume (Pille, J. et al. (2005) *Mol. Ther.* 11:267-274) and can prolong survival of tumor-bearing mice (Kim, W J. et al., (2006) *Mol. Ther.* 14:343-350; Li, S. et al., (2007) *Mol. Ther.* 15:515-523). RNA interference has also shown success with local delivery to the CNS by direct injection (Dorn, G. et al., (2004) *Nucleic Acids* 32:e49; Tan, P H. et al. (2005) *Gene Ther.* 12:59-66; Makimura, H. et a.l (2002) *BMC Neurosci.* 3:18; Shishkina, G T., et al. (2004) *Neuroscience* 129:521-528; Thakker, E R., et al. (2004) *Proc. Natl. Acad. Sci. U.S.A.* 101:17270-17275; Akaneya, Y., et al. (2005) *J. Neurophysiol.* 93:594-602) and to the lungs by intranasal administration (Howard, K A. et al., (2006) *Mol. Ther.* 14:476-484; Zhang, X. et al., (2004) *J. Biol. Chem.* 279:10677-10684; Bitko, V. et al., (2005) *Nat. Med.* 11:50-55). For administering a RNAi agent systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the RNAi agent to the target tissue and avoid undesirable off-target effects (e.g., without wishing to be bound by theory, use of GNAs as described herein has been identified to destabilize the seed region of a dsRNA, resulting in enhanced preference of such dsRNAs for on-target effectiveness, relative to off-target effects, as such off-target effects are significantly weakened by such seed region destabilization). RNAi agents can be modified by chemical conjugation to lipophilic groups such as cholesterol to enhance cellular uptake and prevent degradation. For example, a RNAi agent directed against ApoB conjugated to a lipophilic cholesterol moiety was injected systemically into mice and resulted in knockdown of apoB mRNA in both the liver and jejunum (Soutschek, J. et al., (2004) *Nature* 432:173-178). Conjugation of an RNAi agent to an aptamer has been shown to inhibit tumor growth and mediate tumor regression in a mouse model of prostate cancer (McNamara, J O. et al., (2006) *Nat. Biotechnol.* 24:1005-1015). In an alternative embodiment, the RNAi agent can be delivered using drug delivery systems such as a nanoparticle, a dendrimer, a polymer, liposomes, or a cationic delivery system. Positively charged cationic delivery systems facilitate binding of molecule RNAi agent (negatively charged) and also enhance interactions at the negatively charged cell membrane to permit efficient uptake of an RNAi agent by the cell. Cationic lipids, dendrimers, or polymers can either be bound to an RNAi agent, or induced to form a vesicle or micelle (see e.g., Kim S H. et al., (2008) *Journal of Controlled Release* 129(2):107-116) that encases an RNAi agent. The formation of vesicles or micelles further prevents degradation of the RNAi agent when administered systemically. Methods for making and administering cationic-RNAi agent complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al. (2007) *J. Hypertens.* 25:197-205, which are incorporated herein by reference in their entirety). Some non-limiting examples of drug delivery systems useful for systemic delivery of RNAi agents include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, a RNAi agent forms a complex with cyclodextrin for systemic administration. Methods for administration and pharmaceutical compositions of RNAi agents and cyclodextrins can be found in U.S. Pat. No. 7,427,605, which is herein incorporated by reference in its entirety.

Certain aspects of the instant disclosure relate to a method of reducing the expression of a TMPRSS2 gene in a cell, comprising contacting said cell with the double-stranded RNAi agent of the disclosure. In one embodiment, the cell is a hepatic cell, optionally a hepatocyte. In one embodiment, the cell is an extrahepatic cell, optionally a pulmonary cell.

Another aspect of the disclosure relates to a method of reducing the expression and/or activity of a TMPRSS2 gene in a subject, comprising administering to the subject the double-stranded RNAi agent of the disclosure.

Another aspect of the disclosure relates to a method of treating a subject having a TMPRSS2-associated disorder or at risk of having or at risk of developing a TMPRss2-associated disorder, comprising administering to the subject a therapeutically effective amount of the double-stranded RNAi agent of the disclosure, thereby treating the subject. In some embodiments, the TMPRSS2-associated disorder comprises a coronavirus-associated disorder. Non-limiting examples of coronavirus-associated diseases include, for example, Severe Acute Respiratory Syndrome 2 (SARS-CoV-2; COVID-19), Severe Acute Respiratory Syndrome (SARS-CoV), or Middle East Respiratory Syndrome (MERS-CoV).

In one embodiment, the double-stranded RNAi agent is administered subcutaneously.

In one embodiment, the double-stranded RNAi agent is administered by pulmonary system administration, e.g., intranasal administration, or oral inhalative administration.

In one embodiment, the double-stranded RNAi agent is administered intranasally.

By pulmonary system administration, e.g., intranasal administration or oral inhalative administration, of the double-stranded RNAi agent, the method can reduce the expression of an TMPRSS2 target gene in a pulmonary system tissue, e.g., a nasopharynx tissue, an oropharynx tissue, a laryngopharynx tissue, a larynx tissue, a trachea tissue, a carina tissue, a bronchi tissue, a bronchiole tissue, or an alveoli tissue.

For ease of exposition the formulations, compositions and methods in this section are discussed largely with regard to modified siRNA compounds. It may be understood, however, that these formulations, compositions and methods can be practiced with other siRNA compounds, e.g., unmodified siRNA compounds, and such practice is within the disclosure. A composition that includes a RNAi agent can be delivered to a subject by a variety of routes. Exemplary routes include pulmonary system, intravenous, intraventricular, topical, rectal, anal, vaginal, nasal, and ocular.

The RNAi agents of the disclosure can be incorporated into pharmaceutical compositions suitable for administration. Such compositions typically include one or more species of RNAi agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present disclosure may be administered in a number of ways depending upon whether local or systemic treatment is desired and upon the area to be treated. Administration may be pulmonary, e.g., by inhalation or insufflation of powders or aerosols, including by nebulizer; intratracheal, intranasal, topical (including ophthalmic, vaginal, rectal, intranasal, transdermal), oral, or parenteral. Parenteral administration includes intravenous drip, subcutaneous, intraperitoneal, or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the RNAi agent in powder or aerosol form. The vascular endothelial cells could be targeted by coating a balloon catheter with the RNAi agent and mechanically introducing the RNA.

Compositions for pulmonary system delivery may include aqueous solutions, e.g., for intranasal or oral inhalative administration, suitable carriers composed of, e.g., lipids (liposomes, niosomes, microemulsions, lipidic micelles, solid lipid nanoparticles) or polymers (polymer micelles, dendrimers, polymeric nanoparticles, nanogels, nanocapsules), adjuvant, e.g., for oral inhalative administration. Aqueous compositions may be sterile and may optionally contain buffers, diluents, absorption enhancers and other suitable additives.

Formulations for topical administration may include transdermal patches, ointments, lotions, creams, gels, drops, suppositories, sprays, liquids, and powders. Conventional pharmaceutical carriers, aqueous, powder or oily bases, thickeners and the like may be necessary or desirable. Coated condoms, gloves, and the like may also be useful.

Compositions for oral administration include powders or granules, suspensions or solutions in water, syrups, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening or flavoring agents can be added.

Compositions for intrathecal or intraventricular administration may include sterile aqueous solutions which may also contain buffers, diluents, and other suitable additives.

Formulations for parenteral administration may include sterile aqueous solutions which may also contain buffers, diluents, and other suitable additives. Intraventricular injection may be facilitated by an intraventricular catheter, for example, attached to a reservoir. For intravenous use, the total concentration of solutes may be controlled to render the preparation isotonic.

In one embodiment, the administration of the siRNA compound, e.g., a double-stranded siRNA compound, or ssiRNA compound, composition is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary system, intranasal, urethral, or ocular. Administration can be provided by the subject or by another person, e.g., a health care provider. The medication can be provided in measured doses or in a dispenser which delivers a metered dose. Selected modes of delivery are discussed in more detail below.

Pulmonary System Administration

In one embodiment, the double-stranded RNAi agent is administered by pulmonary system administration. The pulmonary system includes the upper pulmonary system and the lower pulmonary system. The upper pulmonary system includes the nose and the pharynx. The pharynx includes the nasopharynx, oropharynx, and laryngopharynx. The lower pulmonary system includes the larynx, trachea, carina, bronchi, bronchioles, and alveoli.

Pulmonary system administration may be intranasal administration or oral inhalative administration. Such administration permits both systemic and local delivery of the double stranded RNAi agents of the invention.

Intranasal administration may include instilling or insufflating a double stranded RNAi agent into the nasal cavity with syringes or droppers by applying a few drops at a time or via atomization. Suitable dosage forms for intranasal administration include drops, powders, nebulized mists, and sprays.

Oral inhalative administration may include use of device, e.g., a passive breath driven or active power driven single/multiple dose dry powder inhaler (DPI), to deliver a double stranded RNAi agent to the pulmonary system. Suitable dosage forms for oral inhalative administration include powders and solutions. Suitable devices for oral inhalative administration include nebulizers, metered-dose inhalers, and dry powder inhalers. Dry powder inhalers are of the most popular devices used to deliver drugs, especially proteins to the lungs. Exemplary commercially available dry powder inhalers include Spinhaler (Fisons Pharmaceuticals, Rochester, NY) and Rotahaler (GSK, RTP, NC). Several types of nebulizers are available, namely jet nebulizers, ultrasonic nebulizers, vibrating mesh nebulizers. Jet nebulizers are driven by compressed air. Ultrasonic nebulizers use a piezoelectric transducer in order to create droplets from an open liquid reservoir. Vibrating mesh nebulizers use perforated membranes actuated by an annular piezoelement to vibrate in resonant bending mode. The holes in the membrane have a large cross-section size on the liquid supply side and a narrow cross-section size on the side from where the droplets emerge. Depending on the therapeutic application, the hole sizes and number of holes can be adjusted. Selection of a suitable device depends on parameters, such as nature of the drug and its formulation, the site of action, and pathophysiology of the lung. Aqueous suspensions and solutions are nebulized effectively. Aerosols based on mechanically generated vibration mesh technologies also have been used successfully to deliver proteins to lungs. The amount of RNAi agent for pulmonary system administration may vary from one target gene to another target gene and the appropriate amount that has to be applied may have to be determined individually for each target gene. Typically, this amount ranges from 10 μg to 2 mg, preferably 50 μg to 1500 μg, more preferably 100 μg to 1000 μg.

Vector Encoded RNAi Agents of the Disclosure

RNAi agents targeting the TMPRSS2 gene can be expressed from transcription units inserted into DNA or RNA vectors (see, e.g., Couture, A, et al., *TIG*. (1996), 12:5-10; WO 00/22113, WO 00/22114, and U.S. 6,054,299). Expression is preferably sustained (months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of a RNAi agent can be transcribed from a promoter on an expression vector. Where two separate strands are to be expressed to generate, for example, a dsRNA, two separate expression vectors can be co-introduced (e.g., by transfection or infection) into a target cell. Alternatively, each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

RNAi agent expression vectors are generally DNA plasmids or viral vectors. Expression vectors compatible with eukaryotic cells, preferably those compatible with vertebrate cells, can be used to produce recombinant constructs for the expression of a RNAi agent as described herein. Delivery of RNAi agent expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of a RNAi agent will generally require regulatory elements, e.g., promoters, enhancers, etc., to ensure the expression of the RNAi agent in target cells. Other aspects to consider for vectors and constructs are known in the art.

VI. Pharmaceutical Compositions of the Invention

The present disclosure also includes pharmaceutical compositions and formulations which include the RNAi agents of the disclosure. In one embodiment, provided herein are pharmaceutical compositions containing an RNAi agent, as described herein, and a pharmaceutically acceptable carrier. The pharmaceutical compositions containing the RNAi agent are useful for treating a subject who would benefit from inhibiting or reducing the expression of a TMPRSS2 gene, e.g., a subject having a TMPRSS2—associated disorder, e.g, a coronavirus-associated disorder, e.g., a subject having or at risk of having or at risk of developing a coronavirus infection, e.g., a subject having Severe Acute Respiratory Syndrome 2 (SARS-CoV-2; COVID-19), Severe Acute Respiratory Syndrome (SARS-CoV), or Middle East Respiratory Syndrome (MERS-CoV). Such pharmaceutical compositions are formulated based on the mode of delivery. One example is compositions that are formulated for direct delivery into the pulmonary system by intranasal administration or oral inhalative administration, e.g., by inhalation or insufflation of powders or aerosols, including by nebulizer; intratracheal or intranasal delivery. Another example is compositions that are formulated for systemic administration via parenteral delivery, e.g., by intravenous (IV), intramuscular (IM), or for subcutaneous (subQ) delivery.

In some embodiments, the pharmaceutical compositions of the invention are pyrogen free or non-pyrogenic.

The pharmaceutical compositions of the disclosure may be administered in dosages sufficient to inhibit expression of a TMPRSS2 gene. In general, a suitable dose of an RNAi agent of the disclosure will be a flat dose in the range of about 0.001 to about 200.0 mg about once per month to about once per year, typically about once per quarter (i.e., about once every three months) to about once per year, generally a flat dose in the range of about 1 to 50 mg about once per month to about once per year, typically about once per quarter to about once per year.

After an initial treatment regimen (e.g., loading dose), the treatments can be administered on a less frequent basis.

The skilled artisan will appreciate that certain factors can influence the dosage and timing required to effectively treat a subject, including but not limited to the severity of the disease or disorder, previous treatments, the general health or age of the subject, and other diseases present. Moreover, treatment of a subject with a therapeutically effective amount of a composition can include a single treatment or a series of treatments.

Advances in mouse genetics have generated a number of mouse models for the study of various TMPRSS2-associated diseases that would benefit from reduction in the expression of TMPRSS2. Such models can be used for in vivo testing of RNAi agents, as well as for determining a therapeutically effective dose. Suitable mouse models are known in the art and include, for example, the mouse models described elsewhere herein.

The pharmaceutical compositions of the present disclosure can be administered in a number of ways depending upon whether local or systemic treatment is desired and upon the area to be treated. Administration can be topical (e.g., by a transdermal patch), pulmonary system administration by intranasal administration or oral inhalative administration, e.g., by inhalation or insufflation of powders or aerosols, including by nebulizer; intratracheal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The RNAi agents can be delivered in a manner to target a particular tissue, such as the liver, the lung (e.g., bronchioles, alveoli, or bronchus of the lung), or both the liver and lung.

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the RNAi agents featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). RNAi agents featured in the disclosure can be encapsulated within liposomes or can form complexes thereto, in particular to cationic liposomes. Alternatively, RNAi agents can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

A. RNAi Agent Formulations Comprising Membranous Molecular Assemblies

A RNAi agent for use in the compositions and methods of the disclosure can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the RNAi agent composition. The lipophilic material isolates the aqueous interior from an aqueous exterior, which typically does not include the RNAi agent composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the RNAi agent are delivered into the cell where the RNAi agent can specifically bind to a target RNA and can mediate RNAi. In some cases the liposomes are also specifically targeted, e.g., to direct the RNAi agent to particular cell types.

A liposome containing an RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., (1987) *Proc. Natl. Acad. Sci. USA* 8:7413-7417; U.S. Pat. Nos. 4,897,355; 5,171,678; Bangham et al., (1965) *M. Mol. Biol.* 23:238; Olson et al., (1979) *Biochim. Biophys. Acta* 557:9; Szoka et al., (1978) *Proc. Natl. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys.*

*Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.*, 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release,* 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid or phosphatidylcholine or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, (1994) *J. Biol. Chem.* 269:2550; Nabel, (1993) *Proc. Natl. Acad. Sci.* 90:11307; Nabel, (1992) *Human Gene Ther.* 3:649; Gershon, (1993) *Biochem.* 32:7143; and Strauss, (1992) *EMBO J.* 11:417.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al., (1994) *S. T. P. Pharma. Sci.,* 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters*, 223:42; Wu et al., (1993) *Cancer Research*, 53:3765).

Various liposomes comprising one or more glycolipids are known in the art. Papahadjopoulos et al. (*Ann. N.Y. Acad. Sci.*, (1987), 507:64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, (1988), 85,:6949). U.S. Pat. No. 4,837, 028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., (1987) *Proc. Natl. Acad. Sci. USA* 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermylamide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) *Biochim. Biophys. Res. Commun.* 179:280). Lipopolylysine, made by conjugating polylysine to DOPE, has been reported to be effective for transfection in the presence of serum (Zhou, X. et al., (1991) *Biochim. Biophys. Acta* 1065:8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, California) and Lipofectamine (DOSPA) (Life Technology, Inc., Gaithersburg, Maryland). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., (1992) *Journal of Drug Targeting, vol.* 2,405-410 and du Plessis et al., (1992) *Antiviral Research*, 18:259-265; Mannino, R. J. and Fould-Fogerite, S., (1998) *Biotechniques* 6:682-690; Itani, T. et al., (1987) *Gene* 56:267-276; Nicolau, C. et al. (1987) *Meth. Enzymol.* 149:157-176; Straubinger, R. M. and Papahadjopoulos, D. (1983) *Meth. Enzymol.* 101:512-527; Wang, C. Y. and Huang, L., (1987) *Proc. Natl. Acad. Sci. USA* 84:7851-7855).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include RNAi agents can be made highly deformable. Such deformability can enable the liposomes to penetrate through pore that are smaller than the average radius of the liposome. For example, transferosomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present disclosure are described in PCT publication No. WO 2008/042973.

Transfersomes, yet another type of liposomes, are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as those described herein, particularly in emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The RNAi agent for use in the methods of the disclosure can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

Lipid Particles

RNAi agents, e.g., dsRNAs of in the disclosure may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in WO 00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; United States Patent publication No. 2010/0324120 and WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the disclosure.

Certain specific LNP formulations for delivery of RNAi agents have been described in the art, including, e.g., "LNP01" formulations as described in, e.g., WO 2008/042973, which is hereby incorporated by reference.

Additional exemplary lipid-dsRNA formulations are identified in the table below.

| | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |

| | Ionizable/Cationic Lipid | cationic lipid/non-cationic lipid/cholesterol/PEG-lipid conjugate Lipid:siRNA ratio |
|---|---|---|
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)
SNALP (1,2-Dilinolenyloxy-N,N-dimethylaminopropane (DLinDMA)) comprising formulations are described in WO 2009/127060, which is hereby incorporated by reference.
XTC comprising formulations are described in WO 2010/088537, the entire contents of which are hereby incorporated herein by reference.
MC3 comprising formulations are described, e.g., in United States Patent Publication No. 2010/0324120, the entire contents of which are hereby incorporated by reference.
ALNY-100 comprising formulations are described in WO 2010/054406, the entire contents of which are hereby incorporated herein by reference.
C12-200 comprising formulations are described in WO 2010/129709, the entire contents of which are hereby incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the disclosure are administered in conjunction with one or more penetration enhancer surfactants and chelators. Suitable surfactants include fatty acids or esters or salts thereof, bile acids or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the disclosure can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, U.S. 2003/0027780, and U.S. Pat. No. 6,747,014, each of which is incorporated herein by reference.

Compositions for pulmonary system delivery may include aqueous solutions, e.g., for intranasal or oral inhalative administration, suitable carriers composed of, e.g., lipids (liposomes, niosomes, microemulsions, lipidic micelles, solid lipid nanoparticles) or polymers (polymer micelles, dendrimers, polymeric nanoparticles, nanogels, nanocapsules), adjuvant, e.g., for oral inhalative administration. Aqueous compositions may be sterile and may optionally contain buffers, diluents, absorption enhancers and other suitable additives.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the brain when treating APP-associated diseases or disorders.

The pharmaceutical formulations of the present disclosure, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present disclosure can be formulated into any of many possible dosage forms such as, but not limited to, tablets, capsules, gel capsules, liquid syrups, soft gels, suppositories, and enemas. The compositions of the present disclosure can also be formulated as suspensions in aqueous, non-aqueous or mixed media. Aqueous suspensions can further contain substances which increase the viscosity of the suspension including, for example, sodium carboxymethylcellulose, sorbitol or dextran. The suspension can also contain stabilizers.

Additional Formulations i. Emulsions

The compositions of the present disclosure can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, NY, volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present disclosure, the compositions of RNAi agents and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used, and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sesquioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191, 105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or RNAi agents. Microemulsions have also been effective in the transdermal delivery of active components in both cosmetic and pharmaceutical applications. It is expected that the microemulsion compositions and formulations of the present disclosure will facilitate the increased systemic absorption of RNAi agents and nucleic acids from the gastrointestinal tract, as well as improve the local cellular uptake of RNAi agents and nucleic acids.

Microemulsions of the present disclosure can also contain additional components and additives such as sorbitan monostearate (Grill 3), Labrasol, and penetration enhancers to improve the properties of the formulation and to enhance the absorption of the RNAi agents and nucleic acids of the present disclosure. Penetration enhancers used in the microemulsions of the present disclosure can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the disclosure may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present disclosure employs various penetration enhancers to effect the efficient delivery of nucleic acids, particularly RNAi agents, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of RNAi agents through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, NY, 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, MA, 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, NY, 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, NY, 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present disclosure, can be defined as compounds that remove metallic ions from solution by forming complexes therewith, with the result that absorption of RNAi agents through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, MA, 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rd., 1990, 14, 43-51).

As used herein, non-chelating non-surfactant penetration enhancing compounds can be defined as compounds that demonstrate insignificant activity as chelating agents or as surfactants but that nonetheless enhance absorption of RNAi agents through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of RNAi agents at the cellular level can also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (WO 97/30731), are also known to enhance the cellular uptake of dsRNAs.

Other agents can be utilized to enhance the penetration of the administered nucleic acids, including glycols such as ethylene glycol and propylene glycol, pyrrols such as 2-pyrrol, azones, and terpenes such as limonene and menthone.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present disclosure can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings or aromatic substances and the like which do not deleteriously interact with the nucleic acid(s) of the formulation.

Aqueous suspensions can contain substances which increase the viscosity of the suspension including, for example, sodium carboxymethylcellulose, sorbitol or dextran. The suspension can also contain stabilizers.

In some embodiments, pharmaceutical compositions featured in the disclosure include (a) one or more RNAi agents and (b) one or more agents which function by a non-RNAi mechanism and which are useful in treating a TMPRSS2-associated disorder. Examples of such agents include, but are not limited to an antiviral agent, an immune stimulator, a therapeutic vaccine, a viral entry inhibitor, and a combination of any of the foregoing.

Toxicity and therapeutic efficacy of such compounds can be determined by standard pharmaceutical procedures in cell cultures or experimental animals, e g, for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$ Compounds that exhibit high therapeutic indices are preferred.

The data obtained from cell culture assays and animal studies can be used in formulating a range of dosage for use in humans. The dosage of compositions featured herein in the disclosure lies generally within a range of circulating concentrations that include the $ED_{50}$ with little or no toxicity. The dosage can vary within this range depending upon the dosage form employed and the route of administration utilized. For any compound used in the methods featured in the disclosure, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the RNAi agents featured in the disclosure can be administered in combination with other known agents effective in treatment of pathological processes mediated by nucleotide repeat expression. In any event, the administering physician can adjust the amount and timing of RNAi agent administration on the basis of results observed using standard measures of efficacy known in the art or described herein.

VII. Kits

In certain aspects, the instant disclosure provides kits that include a suitable container containing a pharmaceutical formulation of a siRNA compound, e.g., a double-stranded siRNA compound, or siRNA compound, (e.g., a precursor, e.g., a larger siRNA compound which can be processed into a siRNA compound, or a DNA which encodes an siRNA compound, e.g., a double-stranded siRNA compound, or siRNA compound, or precursor thereof). In certain embodiments the individual components of the pharmaceutical formulation may be provided in one container. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device, such as a device suitable for pulmonary administration, e.g., a device suitable for oral inhalative administration including nebulizers, metered-dose inhalers, and dry powder inhalers.

VIII. Methods for Inhibiting TMPRSS2 Expression

The present disclosure also provides methods of inhibiting expression of a TMPRSS2 gene in a cell. The methods include contacting a cell with an RNAi agent, e.g., double stranded RNAi agent, in an amount effective to inhibit expression of a TMPRSS2 gene in the cell, thereby inhibiting expression of TMPRSS2 in the cell. In certain embodiments of the disclosure, expression of a TMPRSS2 gene is inhibited preferentially in the pulmonary system (e.g., lung, bronchial, alveoli) cells. In other embodiments of the disclosure, expression of a TMPRSS2 gene is inhibited preferentially in the liver (e.g., hepatocytes). In certain embodiments of the disclosure, expression of a TMPRSS2 gene is inhibited in the pulmonary system (e.g., lung, bronchial, alveoli) cells and in liver (e.g., hepatocytes) cells.

Contacting of a cell with a RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible.

Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc ligand, or any other ligand that directs the RNAi agent to a site of interest.

The term "inhibiting," as used herein, is used interchangeably with "reducing," "silencing," "downregulating," "suppressing" and other similar terms, and includes any level of inhibition. In certain embodiments, a level of inhibition, e.g., for an RNAi agent of the instant disclosure, can be assessed in cell culture conditions, e.g., wherein cells in cell culture are transfected via Lipofectamine™-mediated transfection at a concentration in the vicinity of a cell of 10 nM or less, 1 nM or less, etc. Knockdown of a given RNAi agent can be determined via comparison of pre-treated levels in cell culture versus post-treated levels in cell culture, optionally also comparing against cells treated in parallel with a scrambled or other form of control RNAi agent. Knockdown in cell culture of, e.g., preferably 50% or more, can thereby be identified as indicative of "inhibiting" or "reducing", "downregulating" or "suppressing", etc. having occurred. It is expressly contemplated that assessment of targeted mRNA or encoded protein levels (and therefore an extent of "inhibiting", etc. caused by a RNAi agent of the disclosure) can also be assessed in in vivo systems for the RNAi agents of the instant disclosure, under properly controlled conditions as described in the art.

The phrase "inhibiting expression of a TMPRSS2 gene" or "inhibiting expression of TMPRSS2," as used herein, includes inhibition of expression of any TMPRSS2 gene (such as, e.g., a mouse TMPRSS2 gene, a rat TMPRSS2 gene, a monkey TMPRSS2 gene, or a human TMPRSS2 gene) as well as variants or mutants of a TMPRSS2 gene that encode a TMPRSS2 protein. Thus, the TMPRSS2 gene may be a wild-type TMPRSS2 gene, a mutant TMPRSS2 gene, or a transgenic TMPRSS2 gene in the context of a genetically manipulated cell, group of cells, or organism.

"Inhibiting expression of a TMPRSS2 gene" includes any level of inhibition of a TMPRSS2 gene, e.g., at least partial suppression of the expression of a TMPRSS2 gene, such as an inhibition by at least 20%. In certain embodiments, inhibition is by at least 30%, at least 40%, preferably at least 50%, at least about 60%, at least 70%, at least about 80%, at least 85%, at least 90%, at least 95%, at least 96%, at least 97%, at least 98%, or at least 99%; or to below the level of detection of the assay method. In a preferred method, inhibition is measured at a 10 nM concentration of the siRNA using the luciferase assay provided in Example 1.

The expression of a TMPRSS2 gene may be assessed based on the level of any variable associated with TMPRSS2 gene expression, e.g., TMPRSS2 mRNA level or TMPRSS2 protein level.

Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the disclosure, expression of a TMPRSS2 gene is inhibited by at least 20%, 30%, 40%, preferably at least 50%, 60%, 70%, 80%, 85%, 90%, or 95%, or to below the level of detection of the assay. In certain embodiments, the methods include a clinically relevant inhibition of expression of TMPRSS2, e.g. as demonstrated by a clinically relevant outcome after treatment of a subject with an agent to reduce the expression of a TMPRSS2 gene.

Inhibition of the expression of a TMPRSS2 gene may be manifested by a reduction of the amount of mRNA expressed by a first cell or group of cells (such cells may be present, for example, in a sample derived from a subject) in which a TMPRSS2 gene is transcribed and which has or have been treated (e.g., by contacting the cell or cells with a RNAi agent of the disclosure, or by administering a RNAi agent of the disclosure to a subject in which the cells are or were present) such that the expression of a TMPRSS2 gene is inhibited, as compared to a second cell or group of cells substantially identical to the first cell or group of cells but which has not or have not been so treated (control cell(s) not treated with a RNAi agent or not treated with a RNAi agent targeted to the genome of interest). The degree of inhibition may be expressed in terms of:

$$\frac{(mRNA \text{ in control cells}) - (mRNA \text{ in treated cells})}{(mRNA \text{ in control cells})} \cdot 100\%$$

In other embodiments, inhibition of the expression of a TMPRSS2 gene may be assessed in terms of a reduction of a parameter that is functionally linked to a TMPRSS2 gene expression, e.g., TMPRSS2 protein expression, S protein priming, efficiency of viral entry, viral load. TMPRSS2 gene silencing may be determined in any cell expressing a TMPRSS2 gene, either endogenous or heterologous from an expression construct, and by any assay known in the art.

Inhibition of the expression of a TMPRSS2 protein may be manifested by a reduction in the level of the TMPRSS2 protein that is expressed by a cell or group of cells (e.g., the level of protein expressed in a sample derived from a subject). As explained above, for the assessment of genome suppression, the inhibition of protein expression levels in a treated cell or group of cells may similarly be expressed as a percentage of the level of protein in a control cell or group of cells.

A control cell or group of cells that may be used to assess the inhibition of the expression of a TMPRSS2 gene includes a cell or group of cells that has not yet been contacted with an RNAi agent of the disclosure. For example, the control cell or group of cells may be derived from an individual subject (e.g., a human or animal subject) prior to treatment of the subject with an RNAi agent.

The level of TMPRSS2 mRNA that is expressed by a cell or group of cells may be determined using any method known in the art for assessing RNA expression. In one embodiment, the level of expression of TMPRSS2 in a sample is determined by detecting a transcribed polynucleotide, or portion thereof, e.g., mRNA of the TMPRSS2 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating TMPRSS2 mRNA may be detected using methods the described in WO2012/177906, the entire contents of which are hereby incorporated herein by reference.

In some embodiments, the level of expression of TMPRSS2 is determined using a nucleic acid probe. The term "probe", as used herein, refers to any molecule that is capable of selectively binding to a specific TMPRSS2 nucleic acid or protein, or fragment thereof. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of RNA levels involves contacting the isolated RNA with a nucleic acid molecule (probe) that can hybridize to TMPRSS2 RNA. In one embodiment, the RNA is immobilized on a solid surface and contacted with a probe, for example by running the isolated RNA on an agarose gel and transferring the RNA from the gel to a membrane, such as nitrocellulose. In an alternative embodiment, the probe(s) are immobilized on a solid surface and the RNA is contacted with the probe(s), for example, in an Affymetrix® gene chip array. A skilled artisan can readily adapt known RNA detection methods for use in determining the level of TMPRSS2 mRNA.

An alternative method for determining the level of expression of TMPRSS2 in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the disclosure, the level of expression of TMPRSS2 is determined by quantitative fluorogenic RT-PCR (i.e., the TaqMan™ System), by a Dual-Glo® Luciferase assay, or by other art-recognized method for measurement of TMPRSS2 expression or mRNA level.

The expression level of TMPRSS2 mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of TMPRSS2 expression level may also comprise using nucleic acid probes in solution.

In some embodiments, the level of RNA expression is assessed using branched DNA (bDNA) assays or real time PCR (qPCR). The use of this PCR method is described and exemplified in the Examples presented herein. Such methods can also be used for the detection of TMPRSS2 nucleic acids.

The level of TMPRSS2 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like. Such assays can also be used for the detection of proteins indicative of the presence or replication of TMPRSS2 proteins.

In some embodiments, the efficacy of the methods of the disclosure in the treatment of a TMPRSS2-related disease is assessed by a decrease in TMPRSS2 mRNA level (e.g, by assessment of a TMPRSS2 level, e.g., in the lung, by biopsy, or otherwise).

In some embodiments, the efficacy of the methods of the disclosure in the treatment of a TMPRSS2-related disease is assessed by a decrease in TMPRSS2 mRNA level (e.g, by assessment of a liver sample for TMPRSS2 level, by biopsy, or otherwise).

In some embodiments of the methods of the disclosure, the RNAi agent is administered to a subject such that the RNAi agent is delivered to a specific site within the subject. The inhibition of expression of TMPRSS2 may be assessed using measurements of the level or change in the level of TMPRSS2 mRNA or TMPRSS2 protein in a sample derived from a specific site within the subject, e.g., lung and/or liver cells. In certain embodiments, the methods include a clinically relevant inhibition of expression of TMPRSS2, e.g. as demonstrated by a clinically relevant outcome after treatment of a subject with an agent to reduce the expression of TMPRSS2.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

IX. Methods of Treating or Preventing TMPRSS2-Associated Diseases

The present disclosure also provides methods of using a RNAi agent of the disclosure or a composition containing a RNAi agent of the disclosure to reduce or inhibit TMPRSS2 expression in a cell. The methods include contacting the cell with a dsRNA of the disclosure and maintaining the cell for a time sufficient to obtain degradation of the mRNA transcripts of a TMPRSS2 gene, thereby inhibiting expression of the TMPRSS2 gene in the cell. Reduction in gene expression can be assessed by any methods known in the art. For example, a reduction in the expression of TMPRSS2 may be determined by determining the mRNA expression level of a TMPRSS2 gene using methods routine to one of ordinary skill in the art, e.g., northern blotting, qRT-PCR; by determining the protein level of a TMPRSS2 protein using methods routine to one of ordinary skill in the art, such as western blotting, immunological techniques.

In the methods of the disclosure the cell may be contacted in vitro or in vivo, i.e., the cell may be within a subject.

A cell suitable for treatment using the methods of the disclosure may be any cell that expresses a TMPRSS2 gene. A cell suitable for use in the methods of the disclosure may be a mammalian cell, e.g., a primate cell (such as a human cell or a non-human primate cell, e.g., a monkey cell or a chimpanzee cell), a non-primate cell (such as a rat cell, or a mouse cell. In one embodiment, the cell is a human cell, e.g., a human lung cell. In one embodiment, the cell is a human cell, e.g., a human liver cell. In one embodiment, the cell is a human cell, e.g., a human lung cell and a human liver cell.

TMPRSS2 expression is inhibited in the cell by at least about 30, 40, 50, 55, 60, 65, 70, 75, 80, 85, 90, 95, 96, 97, 98, 99, or about 100%, i.e., to below the level of detection. In preferred embodiments, TMPRSS2 expression is inhibited by at least 50%.

The in vivo methods of the disclosure may include administering to a subject a composition containing a RNAi agent, where the RNAi agent includes a nucleotide sequence that is complementary to at least a part of an RNA transcript of the TMPRSS2 gene of the subject to be treated. When the organism to be treated is a mammal such as a human, the composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by pulmonary delivery, e.g., oral inhalation or intranasal delivery.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of TMPRSS2, or a therapeutic or prophylactic effect. A depot injection may also provide more consistent serum concentrations. Depot injections may include subcutaneous injections or intramuscular injections. In preferred embodiments, the depot injection is a subcutaneous injection.

In one embodiment, the double-stranded RNAi agent is administered by pulmonary system administration, e.g., intranasal administration or oral inhalative administration. Pulmonary system administration may be via a syringe, a dropper, atomization, or use of device, e.g., a passive breath driven or active power driven single/-multiple dose dry powder inhaler (DPI) device.

The mode of administration may be chosen based upon whether local or systemic treatment is desired and based upon the area to be treated. The route and site of administration may be chosen to enhance targeting.

In one aspect, the present disclosure also provides methods for inhibiting the expression of a TMPRSS2 gene in a mammal. The methods include administering to the mammal a composition comprising a dsRNA that targets a TMPRSS2 gene in a cell of the mammal and maintaining the mammal for a time sufficient to obtain degradation of the RNA transcript of the TMPRSS2 gene, thereby inhibiting expression of the TMPRSS2 gene in the cell. Reduction in genome expression can be assessed by any methods known it the art and by methods, e.g. qRT-PCR, described herein. Reduction in protein production can be assessed by any methods known it the art and by methods, e.g. ELISA, described herein. In one embodiment, a lung biopsy sample serves as the tissue material for monitoring the reduction in TMPRSS2 gene or protein expression (or of a proxy therefore).

The present disclosure further provides methods of treatment of a subject in need thereof. The treatment methods of the disclosure include administering an RNAi agent of the disclosure to a subject, e.g., a subject that would benefit from inhibition of TMPRSS2 expression, in a therapeutically effective amount of a RNAi agent targeting a TMPRSS2 gene or a pharmaceutical composition comprising a RNAi agent targeting a TMPRSS2 gene.

In addition, the present disclosure provides methods of preventing, treating or inhibiting the progression of a TMPRSS2-associated disease or disorder, e.g., a coronavirus-associated disease, such as severe acute respiratory syndrome (SARS), the Middle East respiratory syndrome (MERS), and severe acute respiratory syndrome-2 (SARS-2).

The methods include administering to the subject a therapeutically effective amount of any of the RNAi agent, e.g., dsRNA agents, or the pharmaceutical composition provided herein, thereby preventing, treating, or inhibiting the progression of the TMPRSS2-associated disease or disorder in the subject, such as COVID-19.

An RNAi agent of the disclosure may be administered as a "free RNAi agent." A free RNAi agent is administered in the absence of a pharmaceutical composition. The naked RNAi agent may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the RNAi agent can be adjusted such that it is suitable for administering to a subject.

Alternatively, an RNAi agent of the disclosure may be administered as a pharmaceutical composition, such as a dsRNA liposomal formulation.

Subjects that would benefit from a reduction or inhibition of TMPRSS2 gene expression are those having a TMPRSS2-associated disease, subjects at risk of developing a TMPRSS2-associate disease, e.g., subjects of an age greater than 60 years and/or subjects who are immunocompromised, and subjects at risk of developing a TMPRSS2-associate disease, e.g., during an epidemic or pandemic.

The disclosure further provides methods for the use of a RNAi agent or a pharmaceutical composition thereof, e.g., for treating a subject that would benefit from reduction or inhibition of TMPRSS2 expression, e.g., a subject having a TMPRSS2-associated disorder, in combination with other pharmaceuticals or other therapeutic methods, e.g., with known pharmaceuticals or known therapeutic methods, such as, for example, those which are currently employed for treating these disorders. For example, in certain embodiments, an RNAi agent targeting TMPRSS2 is administered in combination with, e.g., an agent useful in treating a TMPRSS2-associated disorder as described elsewhere herein or as otherwise known in the art. For example, additional agents and treatments suitable for treating a subject that would benefit from reduction in TMPRSS2 expression, e.g., a subject having a TMPRSS2-associated disorder, may include agents currently used to treat symptoms of TMPRSS2-associated disorder. The RNAi agent and additional therapeutic agents may be administered at the same time or in the same combination, e.g., via pulmonary system administration, or the additional therapeutic agent can be administered as part of a separate composition or at separate times or by another method known in the art or described herein.

Exemplary additional therapeutics and treatments include, for example, an antiviral agent, an immune stimulator, a therapeutic vaccine, a viral entry inhibitor, and a combination of any of the foregoing.

In one embodiment, the method includes administering a composition featured herein such that expression of the target TMPRSS2 gene is decreased, for at least one month. In preferred embodiments, expression is decreased for at least 2 months, or 6 months.

Preferably, the RNAi agents useful for the methods and compositions featured herein specifically target RNAs (primary or processed) of the target TMPRSS2 gene. Compositions and methods for inhibiting the expression of these genes using RNAi agents can be prepared and performed as described herein.

Administration of the dsRNA according to the methods of the disclosure may result in a reduction of the severity, signs, symptoms, or markers of such diseases or disorders in a patient with a TMPRSS2-associated disorder. By "reduction" in this context is meant a statistically significant or clinically significant decrease in such level. The reduction can be, for example, at least 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. It is well within the ability of one skilled in the art to monitor efficacy of treatment or prevention by measuring any one of such parameters, or any combination of parameters. In connection with the administration of a RNAi agent targeting TMPRSS2 or pharmaceutical composition thereof, "effective against" a TMPRSS2-associated disorder indicates that administration in a clinically appropriate manner results in a beneficial effect for at least a statistically significant fraction of patients, such as an improvement of symptoms, a cure, a reduction in disease, extension of life, improvement in quality of life, or other effect generally recognized as positive by medical doctors familiar with treating TMPRSS2-associated disorders and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50%, or more can be indicative of effective treatment. Efficacy for a given RNAi agent drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale. Any positive change resulting in e.g., lessening of severity of disease measured using the appropriate scale, represents adequate treatment using a RNAi agent or RNAi agent formulation as described herein.

Subjects can be administered a therapeutic amount of dsRNA, such as about 0.01 mg/kg to about 200 mg/kg.

The RNAi agent can be administered via the pulmonary system over a period of time, on a regular basis. In certain embodiments, after an initial treatment regimen, the treatments can be administered on a less frequent basis. Administration of the RNAi agent can reduce TMPRSS2 levels, e.g., in a cell, tissue, blood, lung sample or other compartment of the patient by at least 20%, 30%, 40%, 50%, 55%, 60%, 65%, 70,% 75%, 80%, 85%, 90%, 95%, 96%, 97%, 98%, or at least about 99% or more. In a preferred embodiment, administration of the RNAi agent can reduce TMPRSS2 levels, e.g., in a cell, tissue, blood, pulmonary system sample or other compartment of the patient by at least 50%.

Before administration of a full dose of the RNAi agent, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the RNAi agent can be administered by pulmonary administration or subcutaneously, i.e., by subcutaneous injection. One or more injections may be used to deliver the desired, e.g., monthly dose of RNAi agent to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of RNAi agent on a regular basis, such as monthly or extending to once a quarter, twice per year, once per year. In certain embodiments, the RNAi agent is administered about once per month to about once per quarter (i.e., about once every three months).

Unless otherwise defined, all technical and scientific terms used herein have the same meaning as commonly understood by one of ordinary skill in the art to which this invention belongs. Although methods and materials similar or equivalent to those described herein can be used in the practice or testing of the RNAi agents and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

An informal Sequence Listing is filed herewith and forms part of the specification as filed.

This invention is further illustrated by the following examples which should not be construed as limiting. The entire contents of all references, patents and published patent applications cited throughout this application, and the Sequence Listing, are hereby incorporated herein by reference.

EXAMPLES

Example 1 iRNA Synthesis

Source of Reagents

Where the source of a reagent is not specifically given herein, such reagent can be obtained from any supplier of reagents for molecular biology at a quality/purity standard for application in molecular biology.

siRNA Design

The selection of siRNA designs targeting human transmembrane serine protease (TMPRSS2) gene (human NCBI refseqID: NM_005656.4; NCBI GeneID: 7113) were designed using custo R and Python scripts. The human NM_005656.4 REFSEQ mRNA has a length of 3450 bases.

A detailed list of a set of the unmodified siRNA sense and antisense strand sequences targeting TMPRSS2 is shown in Table 2.

A detailed list of a set of the modified siRNA sense and antisense strand sequences targeting TMPRSS2 is shown in Table 3.

It is to be understood that, throughout the application, a duplex name without a decimal is equivalent to a duplex name with a decimal which merely references the batch number of the duplex. For example, AD-1230521 is equivalent to AD-1230521.

siRNA Synthesis siRNAs were synthesized and annealed using routine methods known in the art. Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene)amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 μL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA.3HF (triethylamine trihydrofluoride). To each oligonucleotide solution in aqueous methylamine was added 200 μL of dimethyl sulfoxide (DMSO) and 300 μL TEA.3HF and the solution was incubated for approximately 30 mins at 60° C. After incubation, the plate was allowed to come to room temperature and crude oligonucleotides were precipitated by the addition of 1 mL of 9:1 acetontrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 μM in 1× PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2

In Vitro Screening of siRNA Duplexes

Cell Culture and Transfections

Cells, e.g., pulmonary system cells, are cultured according to standard methods and are transfected with the iRNA duplex of interest. For example, primary human hepatocytes (PHH) were transfected by adding 7.5 µL of Opti-MEM plus 0.1 µL of RNAiMAX per well (Invitrogen, Carlsbad CA cat #13778-150) to 2.5 µL of each siRNA duplex to an individual well in a 384-well plate. The cells were then incubated at room temperature for 15 minutes. Forty µL of MEDIA containing ~1.5×10⁴ cells was then added to the siRNA mixture. Cells were incubated for 24 hours prior to RNA purification. Single dose experiments were performed at 10 nM, 1 nM, and 0.1 nM.

Total RNA Isolation Using DYNABEADS mRNA Isolation Kit

Total RNA isolation was performed using DYNABEADS. Briefly, cells were lysed in 10 µl of Lysis/Binding Buffer containing 3 µL of beads per well and mixed for 10 minutes on an electrostatic shaker. The washing steps were automated on a Biotek EL406, using a magnetic plate support. Beads were washed (in 3 µL) once in Buffer A, once in Buffer B, and twice in Buffer E, with aspiration steps in between. Following a final aspiration, complete 12 µL RT mixture was added to each well, as described below.

cDNA Synthesis

For cDNA synthesis, a master mix of 1.5 µl 10× Buffer, 0.6 µl 10×dNTPs, 1.5 µl Random primers, 0.75 µl Reverse Transcriptase, 0.75 µl RNase inhibitor and 9.9 µl of $H_2O$ per reaction were added per well. Plates were sealed, agitated for 10 minutes on an electrostatic shaker, and then incubated at 37 degrees C. for 2 hours. Following this, the plates were agitated at 80 degrees C. for 8 minutes.

Real Time PCR

Two microlitre (µl) of cDNA were added to a master mix containing 0.5 µl of human GAPDH TaqMan Probe (4326317E), 0.5 µl human APOC3, 2 µl nuclease-free water and 5 µl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock-transfected cells. IC50s were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO:15) and antisense UCGAAGuACUcAGCGuAAGdTsdT (SEQ ID NO:16).

The results of the screening of the dsRNA agents listed in Tables 3 and 5 in primary human hepatocytes (PHH) are shown in Table 4.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine -3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-uridine-3'-phosphate |

TABLE 2

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230521 | UUCAUUUAACUCUUUGAAACA | 17 | 2580-2600 | UGUUUCAAAGAGUUAAAUGAAGG | 317 | 2578-2600 |
| AD-1230522 | AAACGUCUUCCUUCUUUAUUA | 18 | 3065-3085 | UAAUAAAGAAGGAAGACGUUUUC | 318 | 3063-3085 |
| AD-1230523 | AACGUCUUCCUUCUUUAUUGA | 19 | 3066-3086 | UCAAUAAAGAAGGAAGACGUUUU | 319 | 3064-3086 |
| AD-1230524 | UGGUGAAAACGUCUUCCUUCA | 20 | 3059-3079 | UGAAGGAAGACGUUUUCACCAUU | 320 | 3057-3079 |
| AD-1230525 | UGGUUUCUUUACGCUGUAUAA | 21 | 841-861 | UUAUACAGCGUAAAGAAACCACU | 321 | 839-861 |
| AD-1230526 | UUCCAGAUACCUAUCAUUACA | 22 | 92-112 | UGUAAUGAUAGGUAUCUGGAAUG | 322 | 90-112 |
| AD-1230527 | UCCAGAUACCUAUCAUUACUA | 23 | 93-113 | UAGUAAUGAUAGGUAUCUGGAAU | 323 | 91-113 |
| AD-1230528 | CAGAUACCUAUCAUUACUCGA | 24 | 95-115 | UCGAGUAAUGAUAGGUAUCUGGA | 324 | 93-115 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230529 | GAUACCUAUCAUUACUCGAUA | 25 | 97-117 | UAUCGAGUAAUGAUAGGUAUCUG | 325 | 95-117 |
| AD-1230530 | CGUGGAAAAACCUCUUAACAA | 26 | 1025-1045 | UUGUUAAGAGGUUUUUCCACGCA | 326 | 1023-1045 |
| AD-1230531 | AGUGAUUUCUCAUCCAAAUUA | 27 | 1124-1144 | UAAUUUGGAUGAGAAAUCACUUU | 327 | 1122-1144 |
| AD-1230532 | UCUCAUCCAAAUUAUGACUCA | 28 | 1131-1151 | UGAGUCAUAAUUUGGAUGAGAAA | 328 | 1129-1151 |
| AD-1230533 | AUCCAAAUUAUGACUCCAAGA | 29 | 1135-1155 | UCUUGGAGUCAUAAUUUGGAUGA | 329 | 1133-1155 |
| AD-1230534 | ACUGGAUUUAUCGACAAAUGA | 30 | 1579-1599 | UCAUUUGUCGAUAAAUCCAGUCC | 330 | 1577-1599 |
| AD-1230535 | UUUGAUGUCUCCAAGUAGUCA | 31 | 2556-2576 | UGACUACUUGGAGACAUCAAAAG | 331 | 2554-2576 |
| AD-1230536 | CAAGACACAUCCUAAAAGGUA | 32 | 3032-3052 | UACCUUUUAGGAUGUGUCUUGGG | 332 | 3030-3052 |
| AD-1230537 | GUAAUGGUGAAAACGUCUUCA | 33 | 3055-3075 | UGAAGACGUUUUCACCAUUACAA | 333 | 3053-3075 |
| AD-1230538 | UGAAAACGUCUUCCUUCUUUA | 34 | 3062-3082 | UAAAGAAGGAAGACGUUUUCACC | 334 | 3060-3082 |
| AD-1230539 | GAAAACGUCUUCCUUCUUUAA | 35 | 3063-3083 | UUAAAGAAGGAAGACGUUUUCAC | 335 | 3061-3083 |
| AD-1230540 | AACUGUAAAGUUCAAUUGUGA | 36 | 3137-3157 | UCACAAUUGAACUUUACAGUUUA | 336 | 3135-3157 |
| AD-1230541 | GUACUCAUCUCAGAGGAAGUA | 37 | 614-634 | UACUUCCUCUGAGAUGAGUACAC | 337 | 612-634 |
| AD-1230542 | CGGCAAUGUCGAUAUCUAUAA | 38 | 782-802 | UUAUAGAUAUCGACAUUGCCGGC | 338 | 780-802 |
| AD-1230543 | GGCAAUGUCGAUAUCUAUAAA | 39 | 783-803 | UUUAUAGAUAUCGACAUUGCCGG | 339 | 781-803 |
| AD-1230544 | GCAAUGUCGAUAUCUAUAAAA | 40 | 784-804 | UUUUAUAGAUAUCGACAUUGCCG | 340 | 782-804 |
| AD-1230545 | CAAUGUCGAUAUCUAUAAAAA | 41 | 785-805 | UUUUUAUAGAUAUCGACAUUGCC | 341 | 783-805 |
| AD-1230546 | GUGGUUUCUUUACGCUGUAUA | 42 | 840-860 | UAUACAGCGUAAAGAAACCACUG | 342 | 838-860 |
| AD-1230547 | AUCCAGAUACCUAUCAUUAA | 43 | 91-111 | UUAAUGAUAGGUAUCUGGAAUGU | 343 | 89-111 |
| AD-1230548 | CCAGAUACCUAUCAUUACUCA | 44 | 94-114 | UGAGUAAUGAUAGGUAUCUGGAA | 344 | 92-114 |
| AD-1230549 | AGAUACCUAUCAUUACUCGAA | 45 | 96-116 | UUCGAGUAAUGAUAGGUAUCUGG | 345 | 94-116 |
| AD-1230550 | GUGAUUUCUCAUCCAAAUUAA | 46 | 1125-1145 | UUAAUUUGGAUGAGAAAUCACUU | 346 | 1123-1145 |
| AD-1230551 | UGAUUUCUCAUCCAAAUUAUA | 47 | 1126-1146 | UAUAAUUUGGAUGAGAAAUCACU | 347 | 1124-1146 |
| AD-1230552 | AUUUCUCAUCCAAAUUAUGAA | 48 | 1128-1148 | UUCAUAAUUUGGAUGAGAAAUCA | 348 | 1126-1148 |
| AD-1230553 | UUUCUCAUCCAAAUUAUGACA | 49 | 1129-1149 | UGUCAUAAUUUGGAUGAGAAAUC | 349 | 1127-1149 |
| AD-1230554 | UUCUCAUCCAAAUUAUGACUA | 50 | 1130-1150 | UAGUCAUAAUUUGGAUGAGAAAU | 350 | 1128-1150 |
| AD-1230555 | AGGUCACUUCAUUUUUAUUAA | 51 | 1708-1728 | UUAAUAAAAAUGAAGUGACCUCU | 351 | 1706-1728 |
| AD-1230556 | AUGUUUCUACACAUUGCUACA | 52 | 2512-2532 | UGUAGCAAUGUGUAGAAACAUAA | 352 | 2510-2532 |
| AD-1230557 | UCAUUUAACUCUUUGAAACUA | 53 | 2581-2601 | UAGUUUCAAAGAGUUAAAUGAAG | 353 | 2579-2601 |
| AD-1230558 | CUAGGACUUAACCUUGAAAUA | 54 | 2903-2923 | UAUUUCAAGGUUAAGUCCUAGCU | 354 | 2901-2923 |
| AD-1230559 | AGACACAUCCUAAAAGGUGUA | 55 | 3034-3054 | UACACCUUUUAGGAUGUGUCUUG | 355 | 3032-3054 |
| AD-1230560 | GACACAUCCUAAAAGGUGUUA | 56 | 3035-3055 | UAACACCUUUUAGGAUGUGUCUU | 356 | 3033-3055 |
| AD-1230561 | AUGGUGAAAACGUCUUCCUUA | 57 | 3058-3078 | UAAGGAAGACGUUUUCACCAUUA | 357 | 3056-3078 |
| AD-1230562 | GUGAAAACGUCUUCCUUCUUA | 58 | 3061-3081 | UAAGAAGGAAGACGUUUUCACCA | 358 | 3059-3081 |
| AD-1230563 | AAAACGUCUUCCUUCUUUAUA | 59 | 3064-3084 | UAUAAAGAAGGAAGACGUUUUCA | 359 | 3062-3084 |
| AD-1230564 | AUGCCUGUUCUUCAAAAGCAA | 60 | 820-840 | UUGCUUUUGAAGAACAGGCAUCA | 360 | 818-840 |
| AD-1230565 | GCCUGUUCUUCAAAAGCAGUA | 61 | 822-842 | UACUGCUUUUGAAGAACAGGCAU | 361 | 820-842 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230566 | UUCAAAAGCAGUGGUUUCUUA | 62 | 830-850 | UAAGAAACCACUGCUUUUGAAGA | 362 | 828-850 |
| AD-1230567 | CUAUCAUUACUCGAUGCUGUA | 63 | 102-122 | UACAGCAUCGAGUAAUGAUAGGU | 363 | 100-122 |
| AD-1230568 | UGCGUGGAAAAACCUCUUAAA | 64 | 1023-1043 | UUUAAGAGGUUUUUCCACGCAGU | 364 | 1021-1043 |
| AD-1230569 | CAAGUAGAAAAAGUGAUUUCA | 65 | 1113-1133 | UGAAAUCACUUUUUCUACUUGGU | 365 | 1111-1133 |
| AD-1230570 | AAGUAGAAAAAGUGAUUUCUA | 66 | 1114-1134 | UAGAAAUCACUUUUUCUACUUGG | 366 | 1112-1134 |
| AD-1230571 | GUAGAAAAGUGAUUUCUCAA | 67 | 1116-1136 | UUGAGAAAUCACUUUUUCUACUU | 367 | 1114-1136 |
| AD-1230572 | UAGAAAAGUGAUUUCUCAUA | 68 | 1117-1137 | UAUGAGAAAUCACUUUUUCUACU | 368 | 1115-1137 |
| AD-1230573 | AAAAGUGAUUUCUCAUCCAAA | 69 | 1121-1141 | UUUGGAUGAGAAAUCACUUUUUC | 369 | 1119-1141 |
| AD-1230574 | GAUUUCUCAUCCAAAUUAUGA | 70 | 1127-1147 | UCAUAAUUUGGAUGAGAAAUCAC | 370 | 1125-1147 |
| AD-1230575 | AAGCCUCUGACUUUCAACGAA | 71 | 1191-1211 | UUCGUUGAAAGUCAGAGGCUUCU | 371 | 1189-1211 |
| AD-1230576 | GCUAGUCACUGGAAAUUGAGA | 72 | 2440-2460 | UCUCAAUUUCCAGUGACUAGCAG | 372 | 2438-2460 |
| AD-1230577 | UUUUGAUGUCUCCAAGUAGUA | 73 | 2555-2575 | UACUACUUGGAGACAUCAAAAGC | 373 | 2553-2575 |
| AD-1230578 | GAUGUGUUUUGUUUUGGACUA | 74 | 2731-2751 | UAGUCCAAAACAAAACACAUCUU | 374 | 2729-2751 |
| AD-1230579 | UUUUGUUUUGGACUCUCUGUA | 75 | 2737-2757 | UACAGAGAGUCCAAAACAAAACA | 375 | 2735-2757 |
| AD-1230580 | GCUGGUUUGCAAGAAUGAAAA | 76 | 2868-2888 | UUUUCAUUCUUGCAAACCAGCCU | 376 | 2866-2888 |
| AD-1230581 | UGGUUUGCAAGAAUGAAAUGA | 77 | 2870-2890 | UCAUUUCAUUCUUGCAAACCAGC | 377 | 2868-2890 |
| AD-1230582 | GGUUUGCAAGAAUGAAAUGAA | 78 | 2871-2891 | UUCAUUUCAUUCUUGCAAACCAG | 378 | 2869-2891 |
| AD-1230583 | UAGGACUUAACCUUGAAAUGA | 79 | 2904-2924 | UCAUUUCAAGGUUAAGUCCUAGC | 379 | 2902-2924 |
| AD-1230584 | GGUGAAAACGUCUUCCUUCUA | 80 | 3060-3080 | UAGAAGGAAGACGUUUUCACCAU | 380 | 3058-3080 |
| AD-1230585 | ACGUCUUCCUUCUUUAUUGCA | 81 | 3067-3087 | UGCAAUAAAGAAGGAAGACGUUU | 381 | 3065-3087 |
| AD-1230586 | CGUCUUCCUUCUUUAUUGCCA | 82 | 3068-3088 | UGGCAAUAAAGAAGGAAGACGUU | 382 | 3066-3088 |
| AD-1230587 | CUGUAAAGUUCAAUUGUGAAA | 83 | 3139-3159 | UUUCACAAUUGAACUUUACAGUU | 383 | 3137-3159 |
| AD-1230588 | GCACCUCAAAGACUAAGAAAA | 84 | 364-384 | UUUUCUUAGUCUUUGAGGUGCAC | 384 | 362-384 |
| AD-1230589 | CACCUCAAAGACUAAGAAAGA | 85 | 365-385 | UCUUUCUUAGUCUUUGAGGUGCA | 385 | 363-385 |
| AD-1230590 | AUCCACCAGCUUUAUGAAACA | 86 | 749-769 | UGUUUCAUAAAGCUGGUGGAUCC | 386 | 747-769 |
| AD-1230591 | UGAUGCCUGUUCUUCAAAAGA | 87 | 818-838 | UCUUUUGAAGAACAGGCAUCACU | 387 | 816-838 |
| AD-1230592 | GAUGCCUGUUCUUCAAAAGCA | 88 | 819-839 | UGCUUUUGAAGAACAGGCAUCAC | 388 | 817-839 |
| AD-1230593 | UGCCUGUUCUUCAAAAGCAGA | 89 | 821-841 | UCUGCUUUUGAAGAACAGGCAUC | 389 | 819-841 |
| AD-1230594 | UCUUCAAAAGCAGUGGUUUCA | 90 | 828-848 | UGAAACCACUGCUUUUGAAGAAC | 390 | 826-848 |
| AD-1230595 | CAUUCCAGAUACCUAUCAUUA | 91 | 90-110 | UAAUGAUAGGUAUCUGGAAUGUU | 391 | 88-110 |
| AD-1230596 | ACCUAUCAUUACUCGAUGCUA | 92 | 100-120 | UAGCAUCGAGUAAUGAUAGGUAU | 392 | 98-120 |
| AD-1230597 | GCGUGGAAAAACCUCUUAACA | 93 | 1024-1044 | UGUUAAGAGGUUUUUCCACGCAG | 393 | 1022-1044 |
| AD-1230598 | CAUUACUCGAUGCUGUUGAUA | 94 | 106-126 | UAUCAACAGCAUCGAGUAAUGAU | 394 | 104-126 |
| AD-1230599 | UUACUCGAUGCUGUUGAUAAA | 95 | 108-128 | UUUAUCAACAGCAUCGAGUAAUG | 395 | 106-128 |
| AD-1230600 | AAGAACAAUGACAUUGCGCUA | 96 | 1158-1178 | UAGCGCAAUGUCAUUGUUCUUGG | 396 | 1156-1178 |
| AD-1230601 | ACAGCAAGAUGGCUUUGAACA | 97 | 127-147 | UGUUCAAAGCCAUCUUGCUGUUA | 397 | 125-147 |
| AD-1230602 | CAGCAAGAUGGCUUUGAACUA | 98 | 128-148 | UAGUUCAAAGCCAUCUUGCUGUU | 398 | 126-148 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230603 | UCAGAGGUCACUUCAUUUUUA | 99 | 1704-1724 | UAAAAAUGAAGUGACCUCUGAAU | 399 | 1702-1724 |
| AD-1230604 | CAGAGGUCACUUCAUUUUUAA | 100 | 1705-1725 | UUAAAAAUGAAGUGACCUCUGAA | 400 | 1703-1725 |
| AD-1230605 | UGUUAUGUUUCUACACAUUGA | 101 | 2508-2528 | UCAAUGUGUAGAAACAUAACAUG | 401 | 2506-2528 |
| AD-1230606 | UAUGUUUCUACACAUUGCUAA | 102 | 2511-2531 | UUAGCAAUGUGUAGAAACAUAAC | 402 | 2509-2531 |
| AD-1230607 | ACGUUCUAUAAAUGAAUGUGA | 103 | 2672-2692 | UCACAUUCAUUUAUAGAACGUUA | 403 | 2670-2692 |
| AD-1230608 | GUUUUGUUUUGGACUCUCUGA | 104 | 2736-2756 | UCAGAGAGUCCAAAACAAAACAC | 404 | 2734-2756 |
| AD-1230609 | GUUUGCAAGAAUGAAAUGAAA | 105 | 2872-2892 | UUUCAUUUCAUUCUUGCAAACCA | 405 | 2870-2892 |
| AD-1230610 | AAGAAUGAAAUGAAUGAUUCA | 106 | 2878-2898 | UGAAUCAUUCAUUUCAUUCUUGC | 406 | 2876-2898 |
| AD-1230611 | GCUAGGACUUAACCUUGAAAA | 107 | 2902-2922 | UUUUCAAGGUUAAGUCCUAGCUG | 407 | 2900-2922 |
| AD-1230612 | AAGACACAUCCUAAAAGGUGA | 108 | 3033-3053 | UCACCUUUUAGGAUGUGUCUUGG | 408 | 3031-3053 |
| AD-1230613 | UGUAAUGGUGAAAACGUCUUA | 109 | 3054-3074 | UAAGACGUUUUCACCAUUACAAC | 409 | 3052-3074 |
| AD-1230614 | AAUGGUGAAAACGUCUUCCUA | 110 | 3057-3077 | UAGGAAGACGUUUUCACCAUUAC | 410 | 3055-3077 |
| AD-1230615 | ACUGUAAAGUUCAAUUGUGAA | 111 | 3138-3158 | UUCACAAUUGAACUUUACAGUUU | 411 | 3136-3158 |
| AD-1230616 | UGUAAAGUUCAAUUGUGAAAA | 112 | 3140-3160 | UUUUCACAAUUGAACUUUACAGU | 412 | 3138-3160 |
| AD-1230617 | ACCUCAAAGACUAAGAAAGCA | 113 | 366-386 | UGCUUUCUUAGUCUUUGAGGUGC | 413 | 364-386 |
| AD-1230618 | CCUCAAAGACUAAGAAAGCAA | 114 | 367-387 | UUGCUUUCUUAGUCUUUGAGGUG | 414 | 365-387 |
| AD-1230619 | CUCAAAGACUAAGAAAGCACA | 115 | 368-388 | UGUGCUUUCUUAGUCUUUGAGGU | 415 | 366-388 |
| AD-1230620 | CACCAGCUUUAUGAAACUGAA | 116 | 752-772 | UUCAGUUUCAUAAAGCUGGUGGA | 416 | 750-772 |
| AD-1230621 | CCGGCAAUGUCGAUAUCUAUA | 117 | 781-801 | UAUAGAUAUCGACAUUGCCGGCA | 417 | 779-801 |
| AD-1230622 | GUUCUUCAAAAGCAGUGGUUA | 118 | 826-846 | UAACCACUGCUUUUGAAGAACAG | 418 | 824-846 |
| AD-1230623 | CUUCAAAAGCAGUGGUUUCUA | 119 | 829-849 | UAGAAACCACUGCUUUUGAAGAA | 419 | 827-849 |
| AD-1230624 | UUGAACAUUCCAGAUACCUAA | 120 | 85-105 | UUAGGUAUCUGGAAUGUUCAAUA | 420 | 83-105 |
| AD-1230625 | ACAUUCCAGAUACCUAUCAUA | 121 | 89-109 | UAUGAUAGGUAUCUGGAAUGUUC | 421 | 87-109 |
| AD-1230626 | UCAUUACUCGAUGCUGUUGAA | 122 | 105-125 | UUCAACAGCAUCGAGUAAUGAUA | 422 | 103-125 |
| AD-1230627 | AGUAGAAAAGUGAUUUCUCA | 123 | 1115-1135 | UGAGAAAUCACUUUUUCUACUUG | 423 | 1113-1135 |
| AD-1230628 | CUCCAAGACCAAGAACAAUGA | 124 | 1148-1168 | UCAUUGUUCUUGGUCUUGGAGUC | 424 | 1146-1168 |
| AD-1230629 | CAAGACCAAGAACAAUGACAA | 125 | 1151-1171 | UUGUCAUUGUUCUUGGUCUUGGA | 425 | 1149-1171 |
| AD-1230630 | CAAGAUGGCUUUGAACUCAGA | 126 | 131-151 | UCUGAGUUCAAAGCCAUCUUGCU | 426 | 129-151 |
| AD-1230631 | GACGUGGUAGUCACUUGUAAA | 127 | 2161-2181 | UUUACAAGUGACUACCACGUCAC | 427 | 2159-2181 |
| AD-1230632 | GUUAUGUUUCUACACAUUGCA | 128 | 2509-2529 | UGCAAUGUGUAGAAACAUAACAU | 428 | 2507-2529 |
| AD-1230633 | UUUGCAAGAAUGAAAUGAAUA | 129 | 2873-2893 | UAUUCAUUUCAUUCUUGCAAACC | 429 | 2871-2893 |
| AD-1230634 | AGGACUUAACCUUGAAAUGGA | 130 | 2905-2925 | UCCAUUUCAAGGUUAAGUCCUAG | 430 | 2903-2925 |
| AD-1230635 | UGUGAAAAUGAAUAUCAUGCA | 131 | 3153-3173 | UGCAUGAUAUUCAUUUUCACAAU | 431 | 3151-3173 |
| AD-1230636 | AGUGAUGCCUGUUCUUCAAAA | 132 | 816-836 | UUUUGAAGAACAGGCAUCACUGU | 432 | 814-836 |
| AD-1230637 | UUCUUCAAAAGCAGUGGUUUA | 133 | 827-847 | UAAACCACUGCUUUUGAAGAACA | 433 | 825-847 |
| AD-1230638 | UCAAAAGCAGUGGUUUCUUUA | 134 | 831-851 | UAAAGAAACCACUGCUUUUGAAG | 434 | 829-851 |
| AD-1230639 | CAAAAGCAGUGGUUUCUUUAA | 135 | 832-852 | UUAAAGAAACCACUGCUUUUGAA | 435 | 830-852 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230640 | GGUUUCUUUACGCUGUAUAGA | 136 | 842-862 | UCUAUACAGCGUAAAGAAACCAC | 436 | 840-862 |
| AD-1230641 | AUACCUAUCAUUACUCGAUGA | 137 | 98-118 | UCAUCGAGUAAUGAUAGGUAUCU | 437 | 96-118 |
| AD-1230642 | AUCAUUACUCGAUGCUGUUGA | 138 | 104-124 | UCAACAGCAUCGAGUAAUGAUAG | 438 | 102-124 |
| AD-1230643 | AAAAGUGAUUUCUCAUCCAA | 139 | 1120-1140 | UUGGAUGAGAAAUCACUUUUUCU | 439 | 1118-1140 |
| AD-1230644 | ACUCCAAGACCAAGAACAAUA | 140 | 1147-1167 | UAUUGUUCUUGGUCUUGGAGUCA | 440 | 1145-1167 |
| AD-1230645 | CCAAGACCAAGAACAAUGACA | 141 | 1150-1170 | UGUCAUUGUUCUUGGUCUUGGAG | 441 | 1148-1170 |
| AD-1230646 | AAGACCAAGAACAAUGACAUA | 142 | 1152-1172 | UAUGUCAUUGUUCUUGGUCUUGG | 442 | 1150-1172 |
| AD-1230647 | CUGGAUUUAUCGACAAAUGAA | 143 | 1580-1600 | UUCAUUUGUCGAUAAAUCCAGUC | 443 | 1578-1600 |
| AD-1230648 | UUCAGAGGUCACUUCAUUUUA | 144 | 1703-1723 | UAAAAUGAAGUGACCUCUGAAUC | 444 | 1701-1723 |
| AD-1230649 | AGAGGUCACUUCAUUUUAUA | 145 | 1706-1726 | UAUAAAAUGAAGUGACCUCUGA | 445 | 1704-1726 |
| AD-1230650 | GAGGUCACUUCAUUUUAUUA | 146 | 1707-1727 | UAAUAAAAUGAAGUGACCUCUG | 446 | 1705-1727 |
| AD-1230651 | GGAACAGAAACAUUUUUGUUA | 147 | 2183-2203 | UAACAAAAAUGUUUCUGUUCCCC | 447 | 2181-2203 |
| AD-1230652 | UGCUAGUCACUGGAAAUUGAA | 148 | 2439-2459 | UUCAAUUUCCAGUGACUAGCAGG | 448 | 2437-2459 |
| AD-1230653 | UUAUGUUUCUACACAUUGCUA | 149 | 2510-2530 | UAGCAAUGUGUAGAAACAUAACA | 449 | 2508-2530 |
| AD-1230654 | CUUUUGAUGUCUCCAAGUAGA | 150 | 2554-2574 | UCUACUUGGAGACAUCAAAAGCU | 450 | 2552-2574 |
| AD-1230655 | UGAUGUCUCCAAGUAGUCCAA | 151 | 2558-2578 | UUGGACUACUUGGAGACAUCAAA | 451 | 2556-2578 |
| AD-1230656 | UUCUAUAAAUGAAUGUGCUGA | 152 | 2675-2695 | UCAGCACAUUCAUUUAUAGAACG | 452 | 2673-2695 |
| AD-1230657 | AGAAUGAAAUGAAUGAUUCUA | 153 | 2879-2899 | UAGAAUCAUUCAUUUCAUUCUUG | 453 | 2877-2899 |
| AD-1230658 | AAUGAAAUGAAUGAUUCUACA | 154 | 2881-2901 | UGUAGAAUCAUUCAUUUCAUUCU | 454 | 2879-2901 |
| AD-1230659 | GGACUUAACCUUGAAAUGGAA | 155 | 2906-2926 | UUCCAUUUCAAGGUUAAGUCCUA | 455 | 2904-2926 |
| AD-1230660 | GACUUAACCUUGAAAUGGAAA | 156 | 2907-2927 | UUUCCAUUUCAAGGUUAAGUCCU | 456 | 2905-2927 |
| AD-1230661 | AGUCAUGCAAUCCCAUUUGCA | 157 | 2927-2947 | UGCAAAUGGGAUUGCAUGACUUU | 457 | 2925-2947 |
| AD-1230662 | GUCAUGCAAUCCCAUUUGCAA | 158 | 2928-2948 | UUGCAAAUGGGAUUGCAUGACUU | 458 | 2926-2948 |
| AD-1230663 | GUGCACCUCAAAGACUAAGAA | 159 | 362-382 | UUCUUAGUCUUUGAGGUGCACAC | 459 | 360-382 |
| AD-1230664 | UCCACCAGCUUUAUGAAACUA | 160 | 750-770 | UAGUUUCAUAAAGCUGGUGGAUC | 460 | 748-770 |
| AD-1230665 | AGCUUUAUGAAACUGAACACA | 161 | 756-776 | UGUGUUCAGUUUCAUAAAGCUGG | 461 | 754-776 |
| AD-1230666 | AUGAAACUGAACACAAGUGCA | 162 | 762-782 | UGCACUUGUGUUCAGUUUCAUAA | 462 | 760-782 |
| AD-1230667 | AUUGAACAUUCCAGAUACCUA | 163 | 84-104 | UAGGUAUCUGGAAUGUUCAAUAU | 463 | 82-104 |
| AD-1230668 | AAAAGCAGUGGUUUCUUUACA | 164 | 833-853 | UGUAAAGAAACCACUGCUUUUGA | 464 | 831-853 |
| AD-1230669 | GUUUCUUUACGCUGUAUAGCA | 165 | 843-863 | UGCUAUACAGCGUAAAGAAACCA | 465 | 841-863 |
| AD-1230670 | AUUACUCGAUGCUGUUGAUAA | 166 | 107-127 | UUAUCAACAGCAUCGAGUAAUGA | 466 | 105-127 |
| AD-1230671 | GACCAAGAACAAUGACAUUGA | 167 | 1154-1174 | UCAAUGUCAUUGUUCUUGGUCUU | 467 | 1152-1174 |
| AD-1230672 | ACCAAGAACAAUGACAUUGCA | 168 | 1155-1175 | UGCAAUGUCAUUGUUCUUGGUCU | 468 | 1153-1175 |
| AD-1230673 | AGCAAGAUGGCUUUGAACUCA | 169 | 129-149 | UGAGUUCAAAGCCAUCUUGCUGU | 469 | 127-149 |
| AD-1230674 | CACGGACUGGAUUUAUCGACA | 170 | 1574-1594 | UGUCGAUAAAUCCAGUCCGUGAA | 470 | 1572-1594 |
| AD-1230675 | ACGGACUGGAUUUAUCGACAA | 171 | 1575-1595 | UUGUCGAUAAAUCCAGUCCGUGA | 471 | 1573-1595 |
| AD-1230676 | UGGAUUUAUCGACAAAUGAGA | 172 | 1581-1601 | UCUCAUUUGUCGAUAAAUCCAGU | 472 | 1579-1601 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230677 | ACGUGGUAGUCACUUGUAAGA | 173 | 2162-2182 | UCUUACAAGUGACUACCACGUCA | 473 | 2160-2182 |
| AD-1230678 | UAGUCACUGGAAAUUGAGGUA | 174 | 2442-2462 | UACCUCAAUUUCCAGUGACUAGC | 474 | 2440-2462 |
| AD-1230679 | AAAUCAAGGAUGCUCAGUUUA | 175 | 2471-2491 | UAAACUGAGCAUCCUUGAUUUCC | 475 | 2469-2491 |
| AD-1230680 | UCUAUAAAUGAAUGUGCUGAA | 176 | 2676-2696 | UUCAGCACAUUCAUUUAUAGAAC | 476 | 2674-2696 |
| AD-1230681 | UAUAAAUGAAUGUGCUGAAGA | 177 | 2678-2698 | UCUUCAGCACAUUCAUUUAUAGA | 477 | 2676-2698 |
| AD-1230682 | UUUGUUUUGGACUCUCUGUGA | 178 | 2738-2758 | UCACAGAGAGUCCAAAACAAAC | 478 | 2736-2758 |
| AD-1230683 | GGCUGGUUUGCAAGAAUGAAA | 179 | 2867-2887 | UUUCAUUCUUGCAAACCAGCCUG | 479 | 2865-2887 |
| AD-1230684 | AGCUAGGACUUAACCUUGAAA | 180 | 2901-2921 | UUUCAAGGUUAAGUCCUAGCUGU | 480 | 2899-2921 |
| AD-1230685 | UCCCAUUUGCAGGAUCUGUCA | 181 | 2937-2957 | UGACAGAUCCUGCAAAUGGGAUU | 481 | 2935-2957 |
| AD-1230686 | AAAGUUCAAUUGUGAAAAUGA | 182 | 3143-3163 | UCAUUUUCACAAUUGAACUUUAC | 482 | 3141-3163 |
| AD-1230687 | UGCACCUCAAAGACUAAGAAA | 183 | 363-383 | UUUCUUAGUCUUUGAGGUGCACA | 483 | 361-383 |
| AD-1230688 | AAAGACUAAGAAAGCACUGUA | 184 | 371-391 | UACAGUGCUUUCUUAGUCUUUGA | 484 | 369-391 |
| AD-1230689 | CAGGUGUACUCAUCUCAGAA | 185 | 609-629 | UCUCUGAGAUGAGUACACCUGAA | 485 | 607-629 |
| AD-1230690 | ACUCUAGCCAAGGAAUAGUGA | 186 | 718-738 | UCACUAUUCCUUGGCUAGAGUAA | 486 | 716-738 |
| AD-1230691 | CAGUGAUGCCUGUUCUUCAAA | 187 | 815-835 | UUUGAAGAACAGGCAUCACUGUG | 487 | 813-835 |
| AD-1230692 | AAAGCAGUGGUUUCUUUACGA | 188 | 834-854 | UCGUAAAGAAACCACUGCUUUUG | 488 | 832-854 |
| AD-1230693 | GCAGUGGUUUCUUUACGCUGA | 189 | 837-857 | UCAGCGUAAAGAAACCACUGCUU | 489 | 835-857 |
| AD-1230694 | CAGUGGUUUCUUUACGCUGUA | 190 | 838-858 | UACAGCGUAAAGAAACCACUGCU | 490 | 836-858 |
| AD-1230695 | CCUAUCAUUACUCGAUGCUGA | 191 | 101-121 | UCAGCAUCGAGUAAUGAUAGGUA | 491 | 99-121 |
| AD-1230696 | AUGACUCCAAGACCAAGAACA | 192 | 1144-1164 | UGUUCUUGGUCUUGGAGUCAUAA | 492 | 1142-1164 |
| AD-1230697 | UCCAAGACCAAGAACAAUGAA | 193 | 1149-1169 | UUCAUUGUUCUUGGUCUUGGAGU | 493 | 1147-1169 |
| AD-1230698 | UUCACGGACUGGAUUUAUCGA | 194 | 1572-1592 | UCGAUAAAUCCAGUCCGUGAAUA | 494 | 1570-1592 |
| AD-1230699 | UGAUUCAGAGGUCACUUCAUA | 195 | 1700-1720 | UAUGAAGUGACCUCUGAAUCAUC | 495 | 1698-1720 |
| AD-1230700 | GAUUCAGAGGUCACUUCAUUA | 196 | 1701-1721 | UAAUGAAGUGACCUCUGAAUCAU | 496 | 1699-1721 |
| AD-1230701 | AUUCAGAGGUCACUUCAUUUA | 197 | 1702-1722 | UAAAUGAAGUGACCUCUGAAUCA | 497 | 1700-1722 |
| AD-1230702 | AGUCACUGGAAAUUGAGGUCA | 198 | 2443-2463 | UGACCUCAAUUUCCAGUGACUAG | 498 | 2441-2463 |
| AD-1230703 | GUUUCUACACAUUGCUACCUA | 199 | 2514-2534 | UAGGUAGCAAUGUGUAGAAACAU | 499 | 2512-2534 |
| AD-1230704 | UUUCUACACAUUGCUACCUCA | 200 | 2515-2535 | UGAGGUAGCAAUGUGUAGAAACA | 500 | 2513-2535 |
| AD-1230705 | UUGAUGUCUCCAAGUAGUCCA | 201 | 2557-2577 | UGGACUACUUGGAGACAUCAAAA | 501 | 2555-2577 |
| AD-1230706 | GUUCUAUAAAUGAAUGUGCUA | 202 | 2674-2694 | UAGCACAUUCAUUUAUAGAACGU | 502 | 2672-2694 |
| AD-1230707 | UGUUUUGGACUCUCUGUGGUA | 203 | 2740-2760 | UACCACAGAGAGUCCAAAACAAA | 503 | 2738-2760 |
| AD-1230708 | UAACCAUGAGCACUACUCUAA | 204 | 2821-2841 | UUAGAGUAGUGCUCAUGGUUAUG | 504 | 2819-2841 |
| AD-1230709 | GCAGGCUGGUUUGCAAGAAUA | 205 | 2864-2884 | UAUUCUUGCAAACCAGCCUGCUU | 505 | 2862-2884 |
| AD-1230710 | CAAGAAUGAAAUGAAUGAUUA | 206 | 2877-2897 | UAAUCAUUCAUUUCAUUCUUGCA | 506 | 2875-2897 |
| AD-1230711 | AAGACUAAGAAAGCACUGUGA | 207 | 372-392 | UCACAGUGCUUUCUUAGUCUUUG | 507 | 370-392 |
| AD-1230712 | CUUCAGGUGUACUCAUCUCAA | 208 | 606-626 | UUGAGAUGAGUACACCUGAAGGA | 508 | 604-626 |
| AD-1230713 | UUCAGGUGUACUCAUCUCAGA | 209 | 607-627 | UCUGAGAUGAGUACACCUGAAGG | 509 | 605-627 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230714 | CCACCAGCUUUAUGAAACUGA | 210 | 751-771 | UCAGUUUCAUAAAGCUGGUGGAU | 510 | 749-771 |
| AD-1230715 | AAGCAGUGGUUUCUUUACGCA | 211 | 835-855 | UGCGUAAAGAAACCACUGCUUUU | 511 | 833-855 |
| AD-1230716 | AGCAGUGGUUUCUUUACGCUA | 212 | 836-856 | UAGCGUAAAGAAACCACUGCUUU | 512 | 834-856 |
| AD-1230717 | CAAGAACAAUGACAUUGCGCA | 213 | 1157-1177 | UGCGCAAUGUCAUUGUUCUUGGU | 513 | 1155-1177 |
| AD-1230718 | CGGACUGGAUUUAUCGACAAA | 214 | 1576-1596 | UUUGUCGAUAAAUCCAGUCCGUG | 514 | 1574-1596 |
| AD-1230719 | GGAUUUAUCGACAAAUGAGGA | 215 | 1582-1602 | UCCUCAUUUGUCGAUAAAUCCAG | 515 | 1580-1602 |
| AD-1230720 | UGACGUGGUAGUCACUUGUAA | 216 | 2160-2180 | UUACAAGUGACUACCACGUCACC | 516 | 2158-2180 |
| AD-1230721 | CGUUCUAUAAAUGAAUGUGCA | 217 | 2673-2693 | UGCACAUUCAUUUAUAGAACGUU | 517 | 2671-2693 |
| AD-1230722 | AGAAAGAUGUGUUUUGUUUUA | 218 | 2726-2746 | UAAAACAAAACACAUCUUUCUCU | 518 | 2724-2746 |
| AD-1230723 | GAAAGAUGUGUUUUGUUUUGA | 219 | 2727-2747 | UCAAAACAAAACACAUCUUUCUC | 519 | 2725-2747 |
| AD-1230724 | AGAUGUGUUUUGUUUUGGACA | 220 | 2730-2750 | UGUCCAAAACAAAACACAUCUUU | 520 | 2728-2750 |
| AD-1230725 | UUGCAAGAAUGAAAUGAAUGA | 221 | 2874-2894 | UCAUUCAUUUCAUUCUUGCAAAC | 521 | 2872-2894 |
| AD-1230726 | UGCAAGAAUGAAAUGAAUGAA | 222 | 2875-2895 | UUCAUUCAUUUCAUUCUUGCAAA | 522 | 2873-2895 |
| AD-1230727 | GCAAGAAUGAAAUGAAUGAUA | 223 | 2876-2896 | UAUCAUUCAUUUCAUUCUUGCAA | 523 | 2874-2896 |
| AD-1230728 | AAGUCAUGCAAUCCCAUUUGA | 224 | 2926-2946 | UCAAAUGGGAUUGCAUGACUUUC | 524 | 2924-2946 |
| AD-1230729 | AUCCCAUUUGCAGGAUCUGUA | 225 | 2936-2956 | UACAGAUCCUGCAAAUGGGAUUG | 525 | 2934-2956 |
| AD-1230730 | UCUGUAGAGAGCAGCAUUCCA | 226 | 2969-2989 | UGGAAUGCUGCUCUCUACAGAGG | 526 | 2967-2989 |
| AD-1230731 | UAAUGGUGAAAACGUCUUCCA | 227 | 3056-3076 | UGGAAGACGUUUUCACCAUUACA | 527 | 3054-3076 |
| AD-1230732 | GUGAAAAUGAAUAUCAUGCAA | 228 | 3154-3174 | UUGCAUGAUAUUCAUUUUCACAA | 528 | 3152-3174 |
| AD-1230733 | UGAAAAUGAAUAUCAUGCAAA | 229 | 3155-3175 | UUUGCAUGAUAUUCAUUUUCACA | 529 | 3153-3175 |
| AD-1230734 | CCUUCAGGUGUACUCAUCUCA | 230 | 605-625 | UGAGAUGAGUACACCUGAAGGAU | 530 | 603-625 |
| AD-1230735 | CGACUGGAACGAGAACUACGA | 231 | 656-676 | UCGUAGUUCUCGUUCCAGUCGUC | 531 | 654-676 |
| AD-1230736 | GGGACAUGGGCUAUAAGAAUA | 232 | 691-711 | UAUUCUUAUAGCCCAUGUCCCUG | 532 | 689-711 |
| AD-1230737 | UUUUACUCUAGCCAAGGAAUA | 233 | 714-734 | UAUUCCUUGGCUAGAGUAAAAAU | 533 | 712-734 |
| AD-1230738 | UACUCUAGCCAAGGAAUAGUA | 234 | 717-737 | UACUAUUCCUUGGCUAGAGUAAA | 534 | 715-737 |
| AD-1230739 | UAUGAAACUGAACACAAGUGA | 235 | 761-781 | UCACUUGUGUUCAGUUUCAUAAA | 535 | 759-781 |
| AD-1230740 | UACCUAUCAUUACUCGAUGCA | 236 | 99-119 | UGCAUCGAGUAAUGAUAGGUAUC | 536 | 97-119 |
| AD-1230741 | AUUCACGGACUGGAUUUAUCA | 237 | 1571-1591 | UGAUAAAUCCAGUCCGUGAAUAC | 537 | 1569-1591 |
| AD-1230742 | UCACGGACUGGAUUUAUCGAA | 238 | 1573-1593 | UUCGAUAAAUCCAGUCCGUGAAU | 538 | 1571-1593 |
| AD-1230743 | AUGAAACCAUGGAUACCAAA | 239 | 178-198 | UUUGGUAUCCAUGGUUUUCAUAG | 539 | 176-198 |
| AD-1230744 | CGUGGUAGUCACUUGUAAGGA | 240 | 2163-2183 | UCCUUACAAGUGACUACCACGUC | 540 | 2161-2183 |
| AD-1230745 | GCGAAGAAGAGAAAGAUGUGA | 241 | 2717-2737 | UCACAUCUUUCUCUUCUUCGCCG | 541 | 2715-2737 |
| AD-1230746 | GAAGAAGAGAAAGAUGUGUUA | 242 | 2719-2739 | UAACACAUCUUUCUCUUCUUCGC | 542 | 2717-2739 |
| AD-1230747 | AAGAAGAGAAAGAUGUGUUUA | 243 | 2720-2740 | UAAACACAUCUUUCUCUUCUUCG | 543 | 2718-2740 |
| AD-1230748 | AGAAGAGAAAGAUGUGUUUUA | 244 | 2721-2741 | UAAAACACAUCUUUCUCUUCUUC | 544 | 2719-2741 |
| AD-1230749 | AUAACCAUGAGCACUACUCUA | 245 | 2820-2840 | UAGAGUAGUGCUCAUGGUUAUGG | 545 | 2818-2840 |
| AD-1230750 | CAGGCUGGUUUGCAAGAAUGA | 246 | 2865-2885 | UCAUUCUUGCAAACCAGCCUGCU | 546 | 2863-2885 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230751 | UCAUGCAAUCCCAUUUGCAGA | 247 | 2929-2949 | UCUGCAAAUGGGAUUGCAUGACU | 547 | 2927-2949 |
| AD-1230752 | CCCAUUUGCAGGAUCUGUCUA | 248 | 2938-2958 | UAGACAGAUCCUGCAAAUGGGAU | 548 | 2936-2958 |
| AD-1230753 | CUCAUCUCAGAGGAAGUCCUA | 249 | 617-637 | UAGGACUUCCUCUGAGAUGAGUA | 549 | 615-637 |
| AD-1230754 | GACGACUGGAACGAGAACUAA | 250 | 654-674 | UUAGUUCUCGUUCCAGUCGUCUU | 550 | 652-674 |
| AD-1230755 | CUAGCCAAGGAAUAGUGGAUA | 251 | 721-741 | UAUCCACUAUUCCUUGGCUAGAG | 551 | 719-741 |
| AD-1230756 | AAACUGUACCACAGUGAUGCA | 252 | 804-824 | UGCAUCACUGUGGUACAGUUUUU | 552 | 802-824 |
| AD-1230757 | CACAGUGAUGCCUGUUCUUCA | 253 | 813-833 | UGAAGAACAGGCAUCACUGUGGU | 553 | 811-833 |
| AD-1230758 | AACAAUGACAUUGCGCUGAUA | 254 | 1161-1181 | UAUCAGCGCAAUGUCAUUGUUCU | 554 | 1159-1181 |
| AD-1230759 | CAAUGACAUUGCGCUGAUGAA | 255 | 1163-1183 | UUCAUCAGCGCAAUGUCAUUGUU | 555 | 1161-1183 |
| AD-1230760 | AAAGAUGUGUUUUGUUUUGGA | 256 | 2728-2748 | UCCAAAACAAAACACAUCUUUCU | 556 | 2726-2748 |
| AD-1230761 | UGCCAAGUGCCAUAACCAUGA | 257 | 2809-2829 | UCAUGGUUAUGGCACUUGGCAAU | 557 | 2807-2829 |
| AD-1230762 | UGUGCACCUCAAAGACUAAGA | 258 | 361-381 | UCUUAGUCUUUGAGGUGCACACU | 558 | 359-381 |
| AD-1230763 | AGACUAAGAAAGCACUGUGCA | 259 | 373-393 | UGCACAGUGCUUUCUUAGUCUUU | 559 | 371-393 |
| AD-1230764 | AGGUGUACUCAUCUCAGAGGA | 260 | 610-630 | UCCUCUGAGAUGAGUACACCUGA | 560 | 608-630 |
| AD-1230765 | CCACAGUGAUGCCUGUUCUUA | 261 | 812-832 | UAAGAACAGGCAUCACUGUGGUA | 561 | 810-832 |
| AD-1230766 | ACAGUGAUGCCUGUUCUUCAA | 262 | 814-834 | UUGAAGAACAGGCAUCACUGUGG | 562 | 812-834 |
| AD-1230767 | UGUUCUUCAAAAGCAGUGGUA | 263 | 825-845 | UACCACUGCUUUUGAAGAACAGG | 563 | 823-845 |
| AD-1230768 | AGAACAAUGACAUUGCGCUGA | 264 | 1159-1179 | UCAGCGCAAUGUCAUUGUUCUUG | 564 | 1157-1179 |
| AD-1230769 | AAGAUGGCUUUGAACUCAGGA | 265 | 132-152 | UCCUGAGUUCAAAGCCAUCUUGC | 565 | 130-152 |
| AD-1230770 | GAUGGCUUUGAACUCAGGGUA | 266 | 134-154 | UACCCUGAGUUCAAAGCCAUCUU | 566 | 132-154 |
| AD-1230771 | GCACUCUCUGCCAUUCUGUGA | 267 | 1751-1771 | UCACAGAAUGGCAGAGAGUGCCA | 567 | 1749-1771 |
| AD-1230772 | GGUGACGUGGUAGUCACUUGA | 268 | 2158-2178 | UCAAGUGACUACCACGUCACCAC | 568 | 2156-2178 |
| AD-1230773 | GUGACGUGGUAGUCACUUGUA | 269 | 2159-2179 | UACAAGUGACUACCACGUCACCA | 569 | 2157-2179 |
| AD-1230774 | CUAGUCACUGGAAAUUGAGGA | 270 | 2441-2461 | UCCUCAAUUUCCAGUGACUAGCA | 570 | 2439-2461 |
| AD-1230775 | ACUGGAAAUUGAGGUCCAUGA | 271 | 2447-2467 | UCAUGGACCUCAAUUUCCAGUGA | 571 | 2445-2467 |
| AD-1230776 | GAAGAAAGAUGUGUUUUUGA | 272 | 2722-2742 | UCAAAACACAUCUUUCUCUUCUU | 572 | 2720-2742 |
| AD-1230777 | GAGAAAGAUGUGUUUUGUUUA | 273 | 2725-2745 | UAAACAAAACACAUCUUUCUCUU | 573 | 2723-2745 |
| AD-1230778 | AAGAUGUGUUUUGUUUUGGAA | 274 | 2729-2749 | UUCCAAAACAAAACACAUCUUUC | 574 | 2727-2749 |
| AD-1230779 | UUGUUUUGGACUCUCUGUGGA | 275 | 2739-2759 | UCCACAGAGAGUCCAAAACAAAA | 575 | 2737-2759 |
| AD-1230780 | UGUACUCAUCUCAGAGGAAGA | 276 | 613-633 | UCUUCCUCUGAGAUGAGUACACC | 576 | 611-633 |
| AD-1230781 | CCAAGAACAAUGACAUUGCGA | 277 | 1156-1176 | UCGCAAUGUCAUUGUUCUUGGUC | 577 | 1154-1176 |
| AD-1230782 | GAACAAUGACAUUGCGCUGAA | 278 | 1160-1180 | UUCAGCGCAAUGUCAUUGUUCUU | 578 | 1158-1180 |
| AD-1230783 | UGACAUUGCGCUGAUGAAGCA | 279 | 1166-1186 | UGCUUCAUCAGCGCAAUGUCAUU | 579 | 1164-1186 |
| AD-1230784 | GGAGAAAGGGAAGACCCAGA | 280 | 1298-1318 | UCUGAGGUCUUCCCUUUCUCCUC | 580 | 1296-1318 |
| AD-1230785 | UUGGCACUCUCUGCCAUUCUA | 281 | 1748-1768 | UAGAAUGGCAGAGAGUGCCAAAG | 581 | 1746-1768 |
| AD-1230786 | CGAAGAAGAGAAAGAUGUGUA | 282 | 2718-2738 | UACACAUCUUUCUCUUCUUCGCC | 582 | 2716-2738 |
| AD-1230787 | AAGAGAAAGAUGUGUUUUGUA | 283 | 2723-2743 | UACAAAACACAUCUUUCUCUUCU | 583 | 2721-2743 |

TABLE 2-continued

Unmodified Sense and Antisense Strand TMPRSS2 dsRNA Sequences

| Duplex Name | Sense Sequence 5' to 3' | SEQ ID NO: | Range in NM_005656.4 | Antisense Sequence 5' to 3' | SEQ ID NO: | Range in NM_005656.4 |
|---|---|---|---|---|---|---|
| AD-1230788 | AGGCUGGUUUGCAAGAAUGAA | 284 | 2866-2886 | UUCAUUCUUGCAAACCAGCCUGC | 584 | 2864-2886 |
| AD-1230789 | UGCAAUCCCAUUUGCAGGAUA | 285 | 2932-2952 | UAUCCUGCAAAUGGGAUUGCAUG | 585 | 2930-2952 |
| AD-1230790 | GCAAUCCCAUUUGCAGGAUCA | 286 | 2933-2953 | UGAUCCUGCAAAUGGGAUUGCAU | 586 | 2931-2953 |
| AD-1230791 | CAUGCCUCUGUAGAGAGCAGA | 287 | 2963-2983 | UCUGCUCUCUACAGAGGCAUGUG | 587 | 2961-2983 |
| AD-1230792 | UCUGGGAUAGAGUGCGACUCA | 288 | 480-500 | UGAGUCGCACUCUAUCCCAGAGU | 588 | 478-500 |
| AD-1230793 | ACUCAUCUCAGAGGAAGUCCA | 289 | 616-636 | UGGACUUCCUCUGAGAUGAGUAC | 589 | 614-636 |
| AD-1230794 | ACGACUGGAACGAGAACUACA | 290 | 655-675 | UGUAGUUCUCGUUCCAGUCGUCU | 590 | 653-675 |
| AD-1230795 | UUUUUACUCUAGCCAAGGAAA | 291 | 713-733 | UUUCCUUGGCUAGAGUAAAAAUU | 591 | 711-733 |
| AD-1230796 | UUACUCUAGCCAAGGAAUAGA | 292 | 716-736 | UCUAUUCCUUGGCUAGAGUAAAA | 592 | 714-736 |
| AD-1230797 | ACUGUACCACAGUGAUGCCUA | 293 | 806-826 | UAGGCAUCACUGUGGUACAGUUU | 593 | 804-826 |
| AD-1230798 | ACCACAGUGAUGCCUGUUCUA | 294 | 811-831 | UAGAACAGGCAUCACUGUGGUAC | 594 | 809-831 |
| AD-1230799 | ACAAUGACAUUGCGCUGAUGA | 295 | 1162-1182 | UCAUCAGCGCAAUGUCAUUGUUC | 595 | 1160-1182 |
| AD-1230800 | AUGACAUUGCGCUGAUGAAGA | 296 | 1165-1185 | UCUUCAUCAGCGCAAUGUCAUUG | 596 | 1163-1185 |
| AD-1230801 | CCAGGAGUGUACGGGAAUGUA | 297 | 1545-1565 | UACAUUCCCGUACACUCCUGGUC | 597 | 1543-1565 |
| AD-1230802 | UAUUCACGGACUGGAUUUAUA | 298 | 1570-1590 | UAUAAAUCCAGUCCGUGAAUACC | 598 | 1568-1590 |
| AD-1230803 | GAUUUAUCGACAAAUGAGGGA | 299 | 1583-1603 | UCCCUCAUUUGUCGAUAAAUCCA | 599 | 1581-1603 |
| AD-1230804 | AGAGAUGAUUCAGAGGUCACA | 300 | 1695-1715 | UGUGACCUCUGAAUCAUCUCUAA | 600 | 1693-1715 |
| AD-1230805 | AGAGAAAGAUGUGUUUUGUUA | 301 | 2724-2744 | UAACAAAACACAUCUUUCUCUUC | 601 | 2722-2744 |
| AD-1230806 | CAAGUGCCAUAACCAUGAGCA | 302 | 2812-2832 | UGCUCAUGGUUAUGGCACUUGGC | 602 | 2810-2832 |
| AD-1230807 | CAUAACCAUGAGCACUACUCA | 303 | 2819-2839 | UGAGUAGUGCUCAUGGUUAUGGC | 603 | 2817-2839 |
| AD-1230808 | CAUUUGCAGGAUCUGUCUGUA | 304 | 2940-2960 | UACAGACAGAUCCUGCAAAUGGG | 604 | 2938-2960 |
| AD-1230809 | UCAUCUCAGAGGAAGUCCUGA | 305 | 618-638 | UCAGGACUUCCUCUGAGAUGAGU | 605 | 616-638 |
| AD-1230810 | CAGGAGUGUACGGGAAUGUGA | 306 | 1546-1566 | UCACAUUCCCGUACACUCCUGGU | 606 | 1544-1566 |
| AD-1230811 | UCUGGCUUUGGCACUCUCUGA | 307 | 1741-1761 | UCAGAGAGUGCCAAAGCCAGACA | 607 | 1739-1761 |
| AD-1230812 | UGGCACUCUCUGCCAUUCUGA | 308 | 1749-1769 | UCAGAAUGGCAGAGAGUGCCAAA | 608 | 1747-1769 |
| AD-1230813 | GGCACUCUCUGCCAUUCUGUA | 309 | 1750-1770 | UACAGAAUGGCAGAGAGUGCCAA | 609 | 1748-1770 |
| AD-1230814 | ACCAUGGAUACCAACCGGAAA | 310 | 184-204 | UUUCCGGUUGGUAUCCAUGGUUU | 610 | 182-204 |
| AD-1230815 | CCAUGGAUACCAACCGGAAAA | 311 | 185-205 | UUUUCCGGUUGGUAUCCAUGGUU | 611 | 183-205 |
| AD-1230816 | GGGAAAUCAAGGAUGCUCAGA | 312 | 2468-2488 | UCUGAGCAUCCUUGAUUUCCCCC | 612 | 2466-2488 |
| AD-1230817 | CCAAGUGCCAUAACCAUGAGA | 313 | 2811-2831 | UCUCAUGGUUAUGGCACUUGGCA | 613 | 2809-2831 |
| AD-1230818 | CAUGCAAUCCCAUUUGCAGGA | 314 | 2930-2950 | UCCUGCAAAUGGGAUUGCAUGAC | 614 | 2928-2950 |
| AD-1230819 | CCAUUUGCAGGAUCUGUCUGA | 315 | 2939-2959 | UCAGACAGAUCCUGCAAAUGGGA | 615 | 2937-2959 |
| AD-1230820 | UGCAGGAUCUGUCUGUGCACA | 316 | 2944-2964 | UGUGCACAGACAGAUCCUGCAAA | 616 | 2942-2964 |

TABLE 3

Modified Sense and Antisense Strand TMPRSS2 dsRNA Sequences

| Duplex Name | Sense Sequence 5' to 3' | SEQ ID NO: | Antisense Sequence 5' to 3' | SEQ ID NO: |
|---|---|---|---|---|
| AD-1230521 | ususcau(Uhd)UfaAfCfUfcuuugaaascsa | 617 | VPusGfsuuuCfaaagagagUfaAfaugaasgsg | 917 |
| AD-1230522 | asasacg(Uhd)CfuUfCfCfuucuuuaususa | 618 | VPusAfsauaAfagaaggaAfgAfcguuususc | 918 |
| AD-1230523 | asascgu(Chd)UfuCfCfUfucuuuausgsa | 619 | VPusCfsaauAfaagaaggAfaGfacguususu | 919 |
| AD-1230524 | usgsuga AfaAfCfGfucuu(Chd)cuuscsa | 620 | VPusGfsaagGfaagacguUfuUfccacasusu | 920 |
| AD-1230525 | usgsguu(Uhd)CfuUfUfAfcgcuguausasa | 621 | VPusUfsauaCfagcguaaAfgAfaaccascsu | 921 |
| AD-1230526 | ususccagAfuAfCfCfuau(Chd)auuascsa | 622 | VPusGfsuaaUfgauagguAfuCfuggaasusg | 922 |
| AD-1230527 | uscscaga(Uhd)aCfCfUfaucauuacsusa | 623 | VPusAfsguaAfugauaggUfaUfcuggasasu | 923 |
| AD-1230528 | csasgaua(Chd)cUfAfUfcauuacucsgsa | 624 | VPusCfsgagUfaaugauaGfgUfaucugsgsa | 924 |
| AD-1230529 | gsasuac(Chd)UfaUfCfAfuuacucgasusa | 625 | VPusAfsucgAfguaaugaUfaGfguaucsusg | 925 |
| AD-1230530 | csgsuggaAfaAfAfCfcucu(Uhd)aacsasa | 626 | VPusUfsguuAfagagguuUfuUfccacgscsa | 926 |
| AD-1230531 | asgsuga(Uhd)UfuCfCfUfcauccaaausua | 627 | VPusAfsauuUfggaugagAfaAfucacususu | 927 |
| AD-1230532 | uscsuca(Uhd)CfcAfAfAfuuaugacuscsa | 628 | VPusGfsaguCfauaauuuGfgAfugagasasa | 928 |
| AD-1230533 | asusccaaAfuUfUfAfUfgacu(Chd)caasgsa | 629 | VPusCfsuugGfagucauaAfuUfuggausga | 929 |
| AD-1230534 | ascsugga(Uhd)uUfAfUfcgacaaausgsa | 630 | VPusCfsauuUfgucgauaAfaUfccagusscsc | 930 |
| AD-1230535 | ususuga(Uhd)GfuCfUfCfcaaguagucsa | 631 | VPusGfsacuAfcuuggagAfcAfucaaasasg | 931 |
| AD-1230536 | csasaga(Chd)AfcAfUfCfcuaaaaggsusa | 632 | VPusAfsccuUfuuaggauGfuGfucuugsgsg | 932 |
| AD-1230537 | gsusaa(Uhd)gGfuGfAfAfaacgucuuscsa | 633 | VPusGfsaagAfcguuuucAfcCfauuacsasa | 933 |
| AD-1230538 | usgsaaaa(Chd)gUfCfUfuccuucuususa | 634 | VPusAfsaagAfaggaagaCfgUfuuucascsc | 934 |
| AD-1230539 | gsasaaa(Chd)GfuCfUfUfccuucuususa | 635 | VPusUfsaaaGfaaggaagAfcGfuuuucsasc | 935 |
| AD-1230540 | asascug(Uhd)AfaAfGfUfucaauugusgsa | 636 | VPusCfsacaAfuugaacuUfuAfcaguususa | 936 |
| AD-1230541 | gsusacu(Chd)AfuCfUfCfagaggaagsusa | 637 | VPusAfscuuCfcucugaAfuGfaguacsasc | 937 |
| AD-1230542 | csgsgcaa(Uhd)gUfCfGfauaucuausasa | 638 | VPusUfsauaGfauaucgaCfaUfugccgsgsc | 938 |
| AD-1230543 | gsgscaa(Uhd)GfuCfGfAfuaucuauasasa | 639 | VPusUfsuauAfgauaucGfcAfuugccgsgsg | 939 |
| AD-1230544 | gscsaaug(Uhd)cGfAfUfaucuauaasasa | 640 | VPusUfsuuaUfagauaucGfaCfauugcscsg | 940 |
| AD-1230545 | csasaug(Uhd)CfgAfUfAfucuauaaasasa | 641 | VPusUfsuuuAfuagauauCfgAfcauugscsc | 941 |
| AD-1230546 | gsusggu(Uhd)UfcUfUfUfacguguaususa | 642 | VPusAfsuacAfgcguaaaGfaAfaccacsusg | 942 |
| AD-1230547 | asusuc(Chd)aGfaUfAfCfcuaucauusasa | 643 | VPusUfsaauGfauaguaUfcUfggaauSgsu | 943 |
| AD-1230548 | cscsaga(Uhd)AfcCfUfAfucauuacuscsa | 644 | VPusGfsaguAfaugauagGfuAfucuggsasa | 944 |
| AD-1230549 | asgsaua(Chd)CfuAfUfCfauuacucgsasa | 645 | VPusUfscgaGfuaaugauAfgGfuaucsgsg | 945 |
| AD-1230550 | gsusgau(Uhd)UfcUfUfAfuccaaauusasa | 646 | VPusUfsaauUfggaugaGfaAfucacsusu | 946 |
| AD-1230551 | usgsauu(Uhd)CfuUfCfAfUfccaaauuasa | 647 | VPusAfsuaaUfuuggaugAfgAfaaucascsu | 947 |
| AD-1230552 | asusuuc(Uhd)CfaUfCfCfaaauuausgsa | 648 | VPusUfscauAfuuuggaUfgAfgaauscsa | 948 |
| AD-1230553 | ususucu(Chd)AfuCfCfAfaauuaugascsa | 649 | VPusGfsucaUfaauuggAfuGfagaaasusc | 949 |
| AD-1230554 | ususuca(Uhd)cCfAfAfuuaugacsusa | 650 | VPusAfsgucAfuaauuugGfaUfgagaasasu | 950 |
| AD-1230555 | asgsguca(Uhd)uUfCfAfuuuuuauuausa | 651 | VPusUfsaauAfaaaaugaAfgUfgaccuscsa | 951 |
| AD-1230556 | asusguu(Uhd)CfuAfCfAfcauugcuascsa | 652 | VPusGfsuagCfauguguAfgAfaacauSasa | 952 |
| AD-1230557 | uscsauu(Uhd)AfaCfUfCfuuugaaacsusa | 653 | VPusAfsguuUfcaaagagUfuUfaaugaaSasg | 953 |

TABLE 3-continued

Modified Sense and Antisense Strand TMPRSS2 dsRNA Sequences

| | | | | |
|---|---|---|---|---|
| AD-1230558 | csusagga(Chd)uUfAfAfccuugaaasusa | 654 | VPusAfsuuuCfaagguuaAfgUfccuagscsu | 954 |
| AD-1230559 | asgsaca(Chd)AfuCfCfUfaaaaggugsusa | 655 | VPusAfscacCfuuuuaggAfuGfugucususg | 955 |
| AD-1230560 | gsascaca(Uhd)cCfUfAfaaaggugususa | 656 | VPusAfsacaCfcuuuuagGfaUfgugucsusu | 956 |
| AD-1230561 | asusgg(Uhd)gAfaAfAfCfgucuuccsusa | 657 | VPusAfsaggAfagacguuUfuCfaccaususa | 957 |
| AD-1230562 | gsusgaaaAfcGfUfCfuucc(Uhd)ucsusa | 658 | VPusAfsagaAfggaagacGfuUfuucacscsa | 958 |
| AD-1230563 | asasaacg(Uhd)cUfUfCfcuucuuuasusa | 659 | VPusAfsuaaAfgaaggaaGfaCfguuuuscsa | 959 |
| AD-1230564 | asusgcc(Uhd)GfuUfCfUfucaaaagcsasa | 660 | VPusUfsgcuUfuugaagaAfcAfggcauscsa | 960 |
| AD-1230565 | gscscug(Uhd)UfcUfUfCfaaaagcagsusa | 661 | VPusAfscugCfuuuugaaGfaAfcaggcsasu | 961 |
| AD-1230566 | ususcaaaAfgCfAfGfuggu(Uhd)ucsusa | 662 | VPusAfsagaAfaccacugCfuUfuugaasgsa | 962 |
| AD-1230567 | csusauca(Uhd)uAfCfUfcgaugcugsusa | 663 | VPusAfscagCfaucgaguAfaUfgauagsgsu | 963 |
| AD-1230568 | usgscg(Uhd)gGfaAfAfAfaccucuuasasa | 664 | VPusUfsuaaGfagguuuuUfcCfacgcasgsu | 964 |
| AD-1230569 | csasag(Uhd)aGfaAfAfAfagugauuuscsa | 665 | VPusGfsaaaUfcacuuuuUfcUfacuugsgsu | 965 |
| AD-1230570 | asasguagAfaAfAfAfguga(Uhd)uucsusa | 666 | VPusAfsgaaAfucacuuuUfuCfuacuusgsg | 966 |
| AD-1230571 | gsusagaaAfaAfGfUfgauu(Uhd)cucsasa | 667 | VPusUfsgagAfaaucacuUfuUfucuacsusu | 967 |
| AD-1230572 | usasgaaaAfaGfUfGfauuu(Chd)ucasusa | 668 | VPusAfsugaGfaaaucacUfuUfuucuascsu | 968 |
| AD-1230573 | asasaag(Uhd)GfaUfUfUfcucauccasasa | 669 | VPusUfsuggAfugagaaaUfcAfcuuuususc | 969 |
| AD-1230574 | gsasuuu(Chd)UfcAfUfCfcaaauuausgsa | 670 | VPusCfsauaAfuuuggauGfaGfaaaucsasc | 970 |
| AD-1230575 | asasgcc(Uhd)CfuGfAfCfuuucaacgsasa | 671 | VPusUfscguUfgaaagucAfgGfaggcuuscsu | 971 |
| AD-1230576 | gscsuag(Uhd)CfaCfUfGfgaaauugasgsa | 672 | VPusCfsucaAfuuuccagUfgAfcuagcsasg | 972 |
| AD-1230577 | ususuuga(Uhd)gUfCfUfccaaguagsusa | 673 | VPusAfscuaCfuuggagaCfaUfcaaaasgsc | 973 |
| AD-1230578 | gsasugug(Uhd)uUfUfGfuuuuggacsusa | 674 | VPusAfsgucCfaaaacaaAfaCfacaucsusu | 974 |
| AD-1230579 | ususuug(Uhd)UfuUfGfGfacucucugsusa | 675 | VPusAfscagAfgaguccaAfaAfcaaaascsa | 975 |
| AD-1230580 | gscsugg(Uhd)UfuGfCfAfagaaugaasasa | 676 | VPusUfsuucAfuucuugcAfaAfccagcsusu | 976 |
| AD-1230581 | usgsguu(Uhd)GfcAfAfGfaaugaaausgsa | 677 | VPusCfsauuUfcauucuuGfcAfaaccasgsc | 977 |
| AD-1230582 | gsgsuuug(Chd)aAfGfAfaugaaaugsasa | 678 | VPusUfscauUfcauucuUfgCfaaaccsasg | 978 |
| AD-1230583 | usasgga(Chd)UfuAfAfCfcuugaaausgsa | 679 | VPusCfsauuUfcaagguuAfaGfuccuasgsc | 979 |
| AD-1230584 | gsgsugaaAfaCfGfUfcuuc(Chd)uucsusa | 680 | VPusAfsgaaGfaagacgUfuUfucaccsasu | 980 |
| AD-1230585 | ascsguc(Uhd)UfcCfUfUfcuuuauugscsa | 681 | VPusGfscaaUfaaagaagGfaAfgacgususu | 981 |
| AD-1230586 | csgsucu(Uhd)CfcUfUfCfuuuauugcsa | 682 | VPusGfsgcaAfuaaagaaGfgAfagacgsusu | 982 |
| AD-1230587 | csusguaaAfgUfUfUfCfaau(Uhd)gugasasa | 683 | VPusUfsucaCfaauugaaCfuUfuacagsusu | 983 |
| AD-1230588 | gscsacc(Uhd)CfaAfAfGfacuaagaasasa | 684 | VPusUfsuucUfuagucuuGfaAfggugcsasc | 984 |
| AD-1230589 | csasccu(Chd)AfaAfGfAfcuaagaaasgsa | 685 | VPusCfsuuuCfuuagucuUfuGfaggugscsa | 985 |
| AD-1230590 | asusccca(Uhd)CfaGfCfUfuuaugaaascsa | 686 | VPusGfsuuuCfauaaagcUfgGfuggauscsc | 986 |
| AD-1230591 | usgsaug(Chd)CfuGfUfUfcuucaaaasgsa | 687 | VPusCfsuuuUfgaagaacAfgGfcaucascsu | 987 |
| AD-1230592 | gsasugc(Uhd)UfgUfUfCfuucaaaagcsa | 688 | VPusGfscuuUfugaagaaCfaGfgcaucsasc | 988 |
| AD-1230593 | usgsccug(Uhd)uCfUfUfUfcaaaagcsasga | 689 | VPusCfsugcUfuuugaagAfaCfaggcasusc | 989 |
| AD-1230594 | uscsuu(Chd)aAfaAfGfCfagugguuuscsa | 690 | VPusGfsaaaCfcacugcuUfuUfgaagsasc | 990 |
| AD-1230595 | csasuuc(Chd)AfgAfUfAfccuaucaususa | 691 | VPusAfsaugAfuagguauCfuGfgaaugsusu | 991 |
| AD-1230596 | ascscua(Uhd)CfaUfUfAfcucgaugcsusa | 692 | VPusAfsgcaUfcgaguaaUfgAfuaggusasu | 992 |

TABLE 3-continued

Modified Sense and Antisense Strand TMPRSS2 dsRNA Sequences

| | | | | |
|---|---|---|---|---|
| AD-1230597 | gscsguggAfaAfAfAfccuc(Uhd)uaascsa | 693 | VPusGfsuuaAfgagguuuUfuCfcacgcsasg | 993 |
| AD-1230598 | csasuua(Chd)UfcGfAfUfgcuguugasusa | 694 | VPusAfsucaAfcagcaucGfaGfuaaugsasu | 994 |
| AD-1230599 | ususacu(Chd)GfaUfGfCfuguugauasasa | 695 | VPusUfsuauCfaacagcaUfcGfaguaasusg | 995 |
| AD-1230600 | asasgaa(Chd)AfaUfGfAfcauugcgcsusa | 696 | VPusAfsgcgCfaaugucaUfuGfuucuusgsg | 996 |
| AD-1230601 | ascsag(Chd)aAfgAfUfGfgcuuugaascsa | 697 | VPusGfsuucAfaagccaUfcUfugcugususa | 997 |
| AD-1230602 | csasgcaaGfaUfGfGfcuu(Uhd)gaacsusa | 698 | VPusAfsguuCfaaagccaUfcUfugcugsusu | 998 |
| AD-1230603 | uscsagagGfuCfAfCfuuca(Uhd)uuususa | 699 | VPusAfsaaaAfugaagugAfcCfcugasasu | 999 |
| AD-1230604 | csasgagg(Uhd)cAfCfUfucauuuusasa | 700 | VPusUfsaaaAfaugaaguGfaCfcucugsasa | 1000 |
| AD-1230605 | usgsuua(Uhd)GfuUfUfCfuacacauusgsa | 701 | VPusCfsaauGfguagaaAfcAfuaacasusg | 1001 |
| AD-1230606 | usasugu(Uhd)UfcUfAfCfacauugcsasa | 702 | VPusUfsagcAfauguguaGfaAfacauasasc | 1002 |
| AD-1230607 | ascsguu(Chd)UfaUfAfAfaugaaugusgsa | 703 | VPusCfsacaUfucauuuaUfaGfaacgususa | 1003 |
| AD-1230608 | gsusuug(Uhd)uUfuUfGfgacucucusgsa | 704 | VPusCfsagaGfaguccaaAfaCfaaaacsasc | 1004 |
| AD-1230609 | gsusuug(Chd)AfaGfAfAfugaaaugasasa | 705 | VPusUfsucaUfuucauucUfuGfcaaacscsa | 1005 |
| AD-1230610 | asasgaa(Uhd)GfaAfAfAfUfgaaugauuscsa | 706 | VPusGfsaauCfauucauuUfcAfuucuusgsc | 1006 |
| AD-1230611 | gscsuaggAfcUfUfAfaccu(Uhd)gaasasa | 707 | VPusUfsuucAfagguuaaGfuCfcuagcsusg | 1007 |
| AD-1230612 | asasgaca(Chd)aUfcCfCfuaaaaggusgsa | 708 | VPusCfsaccUfuuuaggaUfgUfgucuusgsg | 1008 |
| AD-1230613 | usgsuaa(Uhd)GfgUfGfAfaaacgucususa | 709 | VPusAfsagaCfguuuucaCfcAfuuacasasc | 1009 |
| AD-1230614 | asasugg(Uhd)GfaAfAfAfcgucuuccsusa | 710 | VPusAfsggaAfgacguuuUfcAfccauusasc | 1010 |
| AD-1230615 | ascsug(Uhd)aAfaGfUfUfcaauugugsasa | 711 | VPusUfscacAfauugaacUfuUfacagususu | 1011 |
| AD-1230616 | usgsuaaaGfuUfCfAfauug(Uhd)gaasasa | 712 | VPusUfsuucAfcaauugaAfcUfuuacasgsu | 1012 |
| AD-1230617 | ascscu(Chd)aAfaGfAfCfuaagaaagscsa | 713 | VPusGfscuuUfcuuagucUfuUfgaggusgsc | 1013 |
| AD-1230618 | cscsu(Chd)aaAfgAfCfUfaagaaagcsasa | 714 | VPusUfsgcuUfcuuagcCfuUfugaggsusg | 1014 |
| AD-1230619 | csus(Chd)aaaGfaCfUfUfagaaagcascsa | 715 | VPusGfsugcUfuucuuagUfcUfuugagsgsu | 1015 |
| AD-1230620 | csasccag(Chd)uUfuUfAfugaaacugsasa | 716 | VPusUfscagUfuucauaaAfgCfuggugsgsa | 1016 |
| AD-1230621 | cscsgg(Chd)aAfuGfUfCfgauaucuasusa | 717 | VPusAfsuagAfuaucgacAfuUfgccggscsa | 1017 |
| AD-1230622 | gsususcu(Uhd)CfaAfAfAfgcagugguususa | 718 | VPusAfsaccAfcugcuuuUfgAfagaacsasg | 1018 |
| AD-1230623 | csusucaaAfaGfCfAfgugg(Uhd)uucsusa | 719 | VPusAfsgaaAfccacugcUfuUfugaagsasa | 1019 |
| AD-1230624 | ususgaa(Chd)AfuUfCfCfagauaccusasa | 720 | VPusUfsaggUfaucuggaAfuGfuucaasusa | 1020 |
| AD-1230625 | ascsauu(Chd)CfaGfAfUfaccuaucasusa | 721 | VPusAfsugaUfagguaucUfgGfaaugususc | 1021 |
| AD-1230626 | uscsauua(Chd)uCfGfAfaugcuguugsasa | 722 | VPusUfscaaCfagcaucgAfgUfaaugasusa | 1022 |
| AD-1230627 | asgsuagaAfaAfAfGfugau(Uhd)ucuscsa | 723 | VPusGfsagaAfaucacuuUfuUfcuacsususg | 1023 |
| AD-1230628 | csusccaaGfaCfCfAfagaa(Chd)aausgsa | 724 | VPusCfsauuGfuucuuggUfcUfuggagsusc | 1024 |
| AD-1230629 | csasaga(Chd)CfaAfGfAfacaaugacsusa | 725 | VPusUfsgucAfuuguucuUfgGfucuugsgsa | 1025 |
| AD-1230630 | csasaga(Uhd)GfgCfUfUfugaacucasgsa | 726 | VPusCfsugaGfuucaaagCfcAfucuugscsu | 1026 |
| AD-1230631 | gsascg(Uhd)gGfuAfGfUfcacuuguasasa | 727 | VPusUfsuacAfagugacuAfcCfacgucsasc | 1027 |
| AD-1230632 | gsusuaug(Uhd)uUfcUfUfacacauugscsa | 728 | VPusGfscaaUfguguagaAfaCfauaacsasu | 1028 |
| AD-1230633 | ususug(Chd)aAfgAfAfUfgaaaugaasusa | 729 | VPusAfsuucAfuuucauuCfuUfgcaaascsc | 1029 |
| AD-1230634 | asgsgac(Uhd)UfaAfCfCfuugaaaugsgsa | 730 | VPusCfscauUfucaagguUfaAfguccusasg | 1030 |
| AD-1230635 | usgsugaaAfaUfGfAfauau(Chd)augscsa | 731 | VPusGfscauGfauauucaUfuUfucacasasu | 1031 |

TABLE 3-continued

Modified Sense and Antisense Strand TMPRSS2 dsRNA Sequences

| | | | | |
|---|---|---|---|---|
| AD-1230636 | asgsuga(Uhd)GfcCfUfGfuucuucaasasa | 732 | VPusUfsuugAfagaacagGfcAfucacusgsu | 1032 |
| AD-1230637 | ususcuu(Chd)AfaAfAfGfcaguggurusasa | 733 | VPusAfsaacCfacugcuuUfuGfaagaascsa | 1033 |
| AD-1230638 | uscsaaaaGfcAfGfUfgguu(Uhd)cuususa | 734 | VPusAfsaagAfaaccacuGfcUfuuugasasg | 1034 |
| AD-1230639 | csasaaag(Chd)aGfUfGfguuucuusasa | 735 | VPusUfsaaaGfaaaccacUfgCfuuuugsasa | 1035 |
| AD-1230640 | gsguuu(Chd)UfuUfAfCfgcuguauasgsa | 736 | VPusCfsuauAfcagcguaAfaGfaaaccsasc | 1036 |
| AD-1230641 | asusacc(Uhd)AfuCfAfUfuacucgausgsa | 737 | VPusCfsaucGfaguaaugAfuAfgguausscu | 1037 |
| AD-1230642 | asuscau(Uhd)AfcUfCfGfaugcuguusgsa | 738 | VPusCfsaacAfgcaucgaGfuAfaugausasg | 1038 |
| AD-1230643 | asasaaag(Uhd)gAfUfUfucucauccsasa | 739 | VPusUfsggaUfgagaaauCfaCfuuuuuscsu | 1039 |
| AD-1230644 | ascsuc(Chd)aAfgAfCfCfaagaacaasusa | 740 | VPusAfsuugUfucuugguCfuUfggagussca | 1040 |
| AD-1230645 | cscsaaga(Chd)cAfAfGfaacaaugascsa | 741 | VPusGfsucaUfguucuuGfgUfcuuggsasg | 1041 |
| AD-1230646 | asasgac(Chd)AfaGfAfAfcaaugacasusa | 742 | VPusAfsuguCfauuguucUfuGfgucuusgsg | 1042 |
| AD-1230647 | csusgga(Uhd)UfuAfUfCfgacaaaugsasa | 743 | VPusUfscauUfugucgauAfaAfuccagsusc | 1043 |
| AD-1230648 | ususcagaGfgUfCfAfcuu(Chd)auuususa | 744 | VPusAfsaaaUfgaagugaCfcUfcugaasusc | 1044 |
| AD-1230649 | asgsagg(Uhd)CfaCfUfUfcauuuuasusa | 745 | VPusAfsuaaAfaaugaagUfgAfccucusgsa | 1045 |
| AD-1230650 | gsasggu(Chd)AfcUfUfCfauuuuuausa | 746 | VPusAfsauaAfaaugaaGfuUfgaccucsug | 1046 |
| AD-1230651 | gsgsaa(Chd)aGfaAfAfCfauuuuugususa | 747 | VPusAfsacaAfaaauguuUfcCfguuccscsc | 1047 |
| AD-1230652 | usgscuag(Uhd)cAfCfCfUfggaaauugsasa | 748 | VPusUfscaaUfuuccaguGfaCfuagcasgsg | 1048 |
| AD-1230653 | ususaug(Uhd)UfuCfUfAfcacauugcsusa | 749 | VPusAfsgcaAfuguguagAfaAfcauaascsa | 1049 |
| AD-1230654 | csusuu(Uhd)gAfuGfUfCfuccaaguasgsa | 750 | VPusCfsuacUfuggagacAfuCfaaaagscsu | 1050 |
| AD-1230655 | usgsaug(Uhd)CfuCfUfCfAfaguaguccsasa | 751 | VPusUfsggaCfuacuuggAfgAfcaucasasa | 1051 |
| AD-1230656 | ususcua(Uhd)AfaAfUfGfaaugugcususa | 752 | VPusCfsagcAfcauucauUfuAfuagaascsg | 1052 |
| AD-1230657 | asgsaa(Uhd)gAfaAfUfGfaaugauucsusa | 753 | VPusAfsgaaUfcauucauUfuCfauucususg | 1053 |
| AD-1230658 | asasugaaAfuGfAfAfugau(Uhd)cuascsa | 754 | VPusGfsuagAfaucauuCfAfuUfucauuscsu | 1054 |
| AD-1230659 | gsgsacu(Uhd)AfaCfCfUfugaaauggsasa | 755 | VPusUfsccaUfuucaaggUfuAfaguccsusa | 1055 |
| AD-1230660 | gsascu(Uhd)aAfcCfUfUfgaaauggasa | 756 | VPusUfsuccAfuuucaagGfuUfaagucscsu | 1056 |
| AD-1230661 | asgsuca(Uhd)GfcAfAfUfcccauuugscsa | 757 | VPusGfscaaUfgggauuGfcAfugacusuu | 1057 |
| AD-1230662 | gsuscaug(Chd)aAfAfUfCfccauuugcsasa | 758 | VPusUfsgcaAfaugggauUfgCfaugacsusu | 1058 |
| AD-1230663 | gsusgca(Chd)CfuCfUfAfAfagacuaagsasa | 759 | VPusUfscuuAfgucuuugAfgGfugcacsasc | 1059 |
| AD-1230664 | uscscac(Chd)AfgCfUfUfuaugaaacsusa | 760 | VPusAfsguuUfcauaaagCfuGfguggasusc | 1060 |
| AD-1230665 | asgscuu(Uhd)AfuGfAfAfacugaacascsa | 761 | VPusGfsuguUfcaguucAfuAfaagcusgsg | 1061 |
| AD-1230666 | asusgaaa(Chd)uGfAfAfcacaagugscsa | 762 | VPusGfscacUfuguguucAfgUfuucausasa | 1062 |
| AD-1230667 | asusugaa(Chd)aUfUfCfcagauaccsusa | 763 | VPusAfsgguAfucuggaaUfgUfucaausasu | 1063 |
| AD-1230668 | asasaaag(Chd)AfgUfGfGfuuucuuascsa | 764 | VPusGfsuaaAfgaaaccaCfuGfcuuuusgsa | 1064 |
| AD-1230669 | gsusuuc(Uhd)UfuAfCfGfgcuguauasgsa | 765 | VPusGfscuaUfcagcguAfaAfgaaacscsa | 1065 |
| AD-1230670 | asusuac(Chd)CfgAfUfGfcuguugausa | 766 | VPusUfsaucAfcagcauCfgAfguaausgsa | 1066 |
| AD-1230671 | gsasccaaGfaAfCfAfauga(Chd)auusgsa | 767 | VPusCfsaauGfucauuguUfcCfuggucsusu | 1067 |
| AD-1230672 | ascscaagAfaCfAfAfuga(Chd)auugscsa | 768 | VPusCfscaaUfgucauugUfuCfuuggusc | 1068 |
| AD-1230673 | asgs(Chd)aagAfuGfGfCfuuugaacuscsa | 769 | VPusGfsaguUfcaaagccAfuCfuugcusgsu | 1069 |
| AD-1230674 | csascgga(Chd)uGfGfAfuuuaucgascsa | 770 | VPusGfsucgAfuaaauccAfgUfccgusgsasa | 1070 |

TABLE 3-continued

Modified Sense and Antisense Strand TMPRSS2 dsRNA Sequences

| | | | | |
|---|---|---|---|---|
| AD-1230675 | ascsgga(Chd)UfgGfAfUfuuaucgacsasa | 771 | VPusUfsgucGfauaaaucCfaGfuccgusgsa | 1071 |
| AD-1230676 | usgsgau(Uhd)UfaUfCfGfacaaaugasgsa | 772 | VPusCfsucaUfuugucgaUfaAfauccasgsu | 1072 |
| AD-1230677 | ascsgugg(Uhd)aGfUfCfacuuguaasgsa | 773 | VPusCfsuuaCfaagugacUfaCfcacguscsa | 1073 |
| AD-1230678 | usasguca(Chd)uGfGfAfaauugaggsusa | 774 | VPusAfsccuCfaauuuccAfgUfgacuasgsc | 1074 |
| AD-1230679 | asasau(Chd)aAfgGfAfUfgcucaguusasa | 775 | VPusAfsaacUfgagcaucCfuUfgauuuscsc | 1075 |
| AD-1230680 | uscsua(Uhd)aAfaUfGfAfaugugcugsasa | 776 | VPusUfscagCfacauucaUfuUfauagasasc | 1076 |
| AD-1230681 | usasuaaa(Uhd)gAfAfUfgugcugaasgsa | 777 | VPusCfsuucAfgcacauuCfaUfuuauasgsa | 1077 |
| AD-1230682 | ususugu(Uhd)UfuGfGfAfcucucugusgsa | 778 | VPusCfsacaGfagaguccAfaAfacaaasasc | 1078 |
| AD-1230683 | gsgscugg(Uhd)uUfGfCfaagaaugasasa | 779 | VPusUfsucaUfucuugcaAfaCfcagccsusg | 1079 |
| AD-1230684 | asgscuagGfaCfUfUfaacc(Uhd)ugasasa | 780 | VPusUfsucaAfgguuaagUfcCfuagcusgsu | 1080 |
| AD-1230685 | uscscca(Uhd)UfuGfCfAfggaucuguscsa | 781 | VPusGfsacaGfauccugcAfaAfugggasusu | 1081 |
| AD-1230686 | asasagu(Uhd)CfaAfUfUfgugaaaausgsa | 782 | VPusCfsauuUfucacaauUfgAfacuuusasc | 1082 |
| AD-1230687 | usgscac(Chd)UfcAfAfAfgacuaagasasa | 783 | VPusUfsucuUfagucuuuGfaGfgugcascsa | 1083 |
| AD-1230688 | asasaga(Chd)UfaAfGfAfaagcacugsusa | 784 | VPusAfscagUfgcuuucuUfaGfucuuusgsa | 1084 |
| AD-1230689 | csasggug(Uhd)aCfUfCfaucucagasgsa | 785 | VPusCfsucuGfagaugagUfaCfaccugsasa | 1085 |
| AD-1230690 | ascsuc(Uhd)aGfcCfAfAfggaauagusgsa | 786 | VPusCfsacuAfuuccuugGfcUfagagusasa | 1086 |
| AD-1230691 | csasguga(Uhd)gCfCfUfguucuucasasa | 787 | VPusUfsugaAfgaacaggCfaUfcacugsusg | 1087 |
| AD-1230692 | asasag(Chd)aGfuGfGfUfuucuuuacsgsa | 788 | VPusCfsguaAfagaaaccAfcUfgcuuusug | 1088 |
| AD-1230693 | gscsag(Uhd)gGfuUfCfCfuuuacgcusgsa | 789 | VPusCfsagcGfuaaagaaAfcCfacugcsusu | 1089 |
| AD-1230694 | csasgugg(Uhd)uUfCfUfuuacgcugsusa | 790 | VPusAfscagCfguaaagaAfaCfcacugscsu | 1090 |
| AD-1230695 | cscsuau(Chd)AfuUfAfCfucgaugcusgsa | 791 | VPusCfsagcAfucguaAfuGfauaggsusa | 1091 |
| AD-1230696 | asusgac(Uhd)CfcAfAfGfaccaagaascsa | 792 | VPusGfsuucUfuggucuuGfgAfgucausasa | 1092 |
| AD-1230697 | uscscaagAfcCfAfAfgaa(Chd)aausgsasa | 793 | VPusUfscauUfguuccugGfuCfuuggasgsu | 1093 |
| AD-1230698 | ususca(Chd)gGfaCfUfGfgauuuaucsgsa | 794 | VPusCfsgauAfaauccagUfcCfgugaasusa | 1094 |
| AD-1230699 | usgsauu(Chd)AfgAfGfGfucacuucasusa | 795 | VPusAfsugaAfgugaccuCfuGfaaucasusc | 1095 |
| AD-1230700 | gsasuu(Chd)aGfaGfGfUfcacuucaususa | 796 | VPusAfsaugAfgugaccUfcUfgaaucsasu | 1096 |
| AD-1230701 | asusucagAfgGfUfCfacuu(Chd)auususa | 797 | VPusAfsaauGfaagugaCfuCfugaauscsa | 1097 |
| AD-1230702 | asgsuca(Chd)UfgGfAfAfauugagguscsa | 798 | VPusGfsaccUfcaauuucCfaGfugacusasg | 1098 |
| AD-1230703 | gsusuuc(Uhd)AfcAfCfAfuugcuaccsusa | 799 | VPusAfsgguAfgcaauguGfuAfgaaacsasu | 1099 |
| AD-1230704 | ususucua(Chd)aCfAfUfugcuaccuscsa | 800 | VPusGfsaggUfagcaaugUfgUfagaaascsa | 1100 |
| AD-1230705 | ususgaug(Uhd)cUfcCfCfaaguaguscscsa | 801 | VPusGfsgacUfacuuggaGfaCfaucaasasa | 1101 |
| AD-1230706 | gsusucua(Uhd)aAfAfUfgaaugugcsusa | 802 | VPusAfsgcaCfauucauuUfaUfagaacsgsu | 1102 |
| AD-1230707 | usgsuuu(Uhd)GfgAfCfUfcucugugsusa | 803 | VPusAfsccaCfagagaguCfcAfaaacasasa | 1103 |
| AD-1230708 | usasacca(Uhd)gAfGfCfacuacucusasa | 804 | VPusUfsagaGfuagugcCfaUfgguuasusg | 1104 |
| AD-1230709 | gscsagg(Chd)UfgGfUfUfugcaagaasusa | 805 | VPusAfsuucUfugcaaacCfaGfccugcsusu | 1105 |
| AD-1230710 | csasagaa(Uhd)gAfAfAfugaaugaususa | 806 | VPusAfsaucAfuucauuCfaUfucuugscsa | 1106 |
| AD-1230711 | asasagac(Uhd)AfaGfAfAfagcacugsusa | 807 | VPusCfsacaGfugcuuucUfuAfgucuususg | 1107 |
| AD-1230712 | csusucagGfuGfUfAfcuca(Uhd)cucsasa | 808 | VPusUfsgagAfugaguacAfcCfugaagsasa | 1108 |
| AD-1230713 | ususcagg(Uhd)gUfAfCfucaucucasgsa | 809 | VPusCfsugaGfaugaguaCfaCfcugaasgsg | 1109 |

TABLE 3-continued

Modified Sense and Antisense Strand TMPRSS2 dsRNA Sequences

| | | | | |
|---|---|---|---|---|
| AD-1230714 | cscsac(Chd)aGfcUfUfUfaugaaacusgsa | 810 | VPusCfsaguUfucauaaaGfcUfgguggsasu | 1110 |
| AD-1230715 | asasgcag(Uhd)gGfUfUfUfucuuuacgscsa | 811 | VPusGfscguAfaagaaaCfaCfugcuususu | 1111 |
| AD-1230716 | asgscag(Uhd)GfgUfUfUfcuuuacgcsusa | 812 | VPusAfsgcgUfaaagaaaCfcAfcugcususu | 1112 |
| AD-1230717 | csasagaa(Chd)aAfUfGfacauugcgscsa | 813 | VPusGfscgcAfaugucauUfgUfucuugsgsu | 1113 |
| AD-1230718 | csgsgac(Uhd)GfgAfUfUfuaucgacasasa | 814 | VPusUfsuguCfgauaaauCfcAfguccgsusg | 1114 |
| AD-1230719 | gsgsauu(Uhd)AfuCfGfAfcaaaugagsgsa | 815 | VPusCfscucAfuuugucgAfuAfaauccsasg | 1115 |
| AD-1230720 | usgsacg(Uhd)GfgUfAfGfucacuugusasa | 816 | VPusUfsacaAfgugacuaCfcAfcgucascsc | 1116 |
| AD-1230721 | csgsuuc(Uhd)AfuAfAfAfugaaugugscsa | 817 | VPusGfscacAfuucauuuAfuAfgaacgsusu | 1117 |
| AD-1230722 | asgsaaagAfUfGfUfGfuuu(Uhd)guuususa | 818 | VPusAfsaaaCfaaaacacAfUfcuuucuscsu | 1118 |
| AD-1230723 | gsasaaga(Uhd)gUfGfUfuuuguuuusgsa | 819 | VPusCfsaaaAfcaaaacaCfaUfcuuucsusc | 1119 |
| AD-1230724 | asgsaug(Uhd)GfuUfUfUfguuuuggascsa | 820 | VPusGfsuccAfaaacaaaAfcAfcaucususu | 1120 |
| AD-1230725 | ususgcaaGfaAfUfGfaaa(Uhd)gaausgsa | 821 | VPusCfsauuCfauuucauUfcUfugcaasasc | 1121 |
| AD-1230726 | usgscaagAfaUfGfAfaa(Uhd)gaaugsasa | 822 | VPusUfscauUfcauuucaUfcUfuugcasasa | 1122 |
| AD-1230727 | gscsaagaAfuGfAfAfaugaa(Uhd)gasusa | 823 | VPusAfsucaUfcauuucAfuUfcuugcsasa | 1123 |
| AD-1230728 | asasguca(Uhd)gCfAfAfucccauuusgsa | 824 | VPusCfsaaaUfgggaugCfaUfgacuususcs | 1124 |
| AD-1230729 | asusccca(Uhd)uUfGfCfaggaucugsusa | 825 | VPusAfscagAfuccugcaAfaUfgggaususcg | 1125 |
| AD-1230730 | uscsug(Uhd)aGfaGfAfGfcagcauucscsa | 826 | VPusGfsgaaUfgcugcucUfcUfacagasgsg | 1126 |
| AD-1230731 | usasaugg(Uhd)gAfAfAfacgucuucscsa | 827 | VPusGfsgaaGfacguuuuCfaCfcauuascsa | 1127 |
| AD-1230732 | gsusgaaaAfuGfAfAfuauca(Uhd)gcsasa | 828 | VPusUfsgcaUfgauauucAfuUfuucacsasa | 1128 |
| AD-1230733 | usgsaaaa(Uhd)gAfAfUfaucaugcasasa | 829 | VPusUfsugcAfugauauuCfaUfuuucascsa | 1129 |
| AD-1230734 | cscsuu(Chd)aGfgUfGfUfacucaucuscsa | 830 | VPusGfsagaUfgaguacaCfcUfgaaggsasu | 1130 |
| AD-1230735 | csgsac(Uhd)gGfaAfCfGfagaacuacsgsa | 831 | VPusCfsguaGfuucucguUfcCfagucgsusc | 1131 |
| AD-1230736 | gsgsgaca(Uhd)gGfGfCfuauaagaasusa | 832 | VPusAfsuucUfuauagccUfaUfgucccsusg | 1132 |
| AD-1230737 | ususuua(Chd)UfcUfAfGfccaaggaasusa | 833 | VPusAfsuucCfuuggcuaGfaGfuaaaasasu | 1133 |
| AD-1230738 | usascuc(Uhd)AfgCfCfAfaggaauagsusa | 834 | VPusAfscuaUfuccuuggCfuAfgaguasasa | 1134 |
| AD-1230739 | usasugaaAfcUfGfAfaca(Chd)aagusgsa | 835 | VPusCfsacuUfguguucaGfuUfucauasasa | 1135 |
| AD-1230740 | usasccua(Uhd)cAfUfUfacucgaugscsa | 836 | VPusGfscauCfgaguaauGfaUfagguasusc | 1136 |
| AD-1230741 | asusuca(Chd)GfgAfCfUfuggauuuausca | 837 | VPusGfsauaAfauccaguCfcGfugaausasc | 1137 |
| AD-1230742 | uscsacggAfcUfGfGfauu(Uhd)aucgsasa | 838 | VPusUfscgaUfaaaccaGfuCfcgugasasu | 1138 |
| AD-1230743 | asusgaaaAfcCfAfUfgga(Uhd)accasasa | 839 | VPusUfsuggUfuccaugGfuUfuucausasg | 1139 |
| AD-1230744 | csgsugg(Uhd)AfgUfCfAfcuuguaagsgsa | 840 | VPusCfscuuAfcaagugaCfuAfccacgsusc | 1140 |
| AD-1230745 | gscsgaagAfaGfAfAfGfaaaga(Uhd)gusgsa | 841 | VPusCfsacaUfcuuucucUfuCfuucgcscsg | 1141 |
| AD-1230746 | gsasagaaGfaGfAfAfaga(Uhd)gugususa | 842 | VPusAfsacaCfaucuuuCfuCfuucuuscsg | 1142 |
| AD-1230747 | asasgaagAfgAfAfAfgaug(Uhd)guusasa | 843 | VPusAfsaacAfcaucuuuCfuCfuucuuscsg | 1143 |
| AD-1230748 | asgsaagaGfaAfAfGfaug(Uhd)guuusasa | 844 | VPusAfsaaaCfacaucuuUfcUfcuucususc | 1144 |
| AD-1230749 | asusaac(Chd)AfuGfAfGfcacuacucsusa | 845 | VPusAfsgagUfagugcucAfuGfguuausgsg | 1145 |
| AD-1230750 | csasggc(Uhd)GfgUfUfUfgcaagaausgsa | 846 | VPusCfsauuCfuugcaaaCfcAfgccugscsu | 1146 |
| AD-1230751 | uscsaug(Chd)AfaUfCfCfcauuugcasgsa | 847 | VPusCfsugcAfaaugggaUffGfcaugascsu | 1147 |
| AD-1230752 | cscscau(Uhd)UfgCfAfGfgaucugucsusa | 848 | VPusAfsgacAfgauccugCfaAfaugggsasu | 1148 |

TABLE 3-continued

Modified Sense and Antisense Strand TMPRSS2 dsRNA Sequences

| AD-1230753 | csuscau(Chd)UfcAfGfAfggaaguccsusa | 849 | VPusAfsggaCfuuccucuGfaGfaugagsusa | 1149 |
| --- | --- | --- | --- | --- |
| AD-1230754 | gsascga(Chd)UfgGfAfAfcgagaacususa | 850 | VPusUfsaguUfcucguucCfaGfucgucsusu | 1150 |
| AD-1230755 | csusagc(Chd)AfaGfGfAfauaguggasusa | 851 | VPusAfsuccAfcuauuccUfuGfgcuagsasg | 1151 |
| AD-1230756 | asasacug(Uhd)aCfCfAfcagugaugscsa | 852 | VPusGfscauCfacugugGfaCfaguuususu | 1152 |
| AD-1230757 | csascag(Uhd)GfaUfGfCfcuguucuuscsa | 853 | VPusGfsaagAfacaggcaUfcAfcugusgsu | 1153 |
| AD-1230758 | asascaa(Uhd)GfaCfAfUfugcgcugasusa | 854 | VPusAfsucaGfcgcaaugUfcAfuuguuscsu | 1154 |
| AD-1230759 | csasauga(Chd)aUfUfGfcgcugaugsasa | 855 | VPusUfscauCfagcgcaaUfgUfcauugsusu | 1155 |
| AD-1230760 | asasaga(Uhd)GfuGfUfUfuuguuugsgsa | 856 | VPusCfscaaAfacaaaacAfcAfucuuuscsu | 1156 |
| AD-1230761 | usgsccaaGfuGfCfCfauaa(Chd)causgsa | 857 | VPusCfsaugGfuuauggcAfcUfuggcasasu | 1157 |
| AD-1230762 | usgsugca(Chd)cUfCfAfaagacuaasgsa | 858 | VPusCfsuuaGfucuuugaGfgUfgcacascsu | 1158 |
| AD-1230763 | asgsac(Uhd)aAfgAfAfAfgcacugugscsa | 859 | VPusGfscacAfgugcuuuCfuUfagucususu | 1159 |
| AD-1230764 | asgsgug(Uhd)AfcUfCfAfucucagagsgsa | 860 | VPusCfscucUfgagaugaGfuAfcaccusgsa | 1160 |
| AD-1230765 | cscsacag(Uhd)gAfuGfGfccuguucususa | 861 | VPusAfsagaAfcaggcauCfaCfuguggsusa | 1161 |
| AD-1230766 | ascsag(Uhd)gAfuGfCfCfuguucuucsasa | 862 | VPusUfsgaaGfaacaggcAfuCfacugusgsg | 1162 |
| AD-1230767 | usgsuuc(Uhd)UfcAfAfAfagcaguggsusa | 863 | VPusAfsccaCfugcuuuuGfaAfgaacasgsg | 1163 |
| AD-1230768 | asgsaa(Chd)aAfuGfAfCfauugcgcusgsa | 864 | VPusCfsagcGfcaaugucAfuUfguucususg | 1164 |
| AD-1230769 | asasga(Uhd)gGfcUfUfUfgaacucagsgsa | 865 | VPusCfscugAfguucaaaGfcCfaucuusgsc | 1165 |
| AD-1230770 | gsasugg(Chd)UfuUfGfAfacucagggsusa | 866 | VPusAfsccccUfgaguucaAfaGfccaucsusu | 1166 |
| AD-1230771 | gscsacu(Chd)UfcUfGfCfcauucugusgsa | 867 | VPusCfsacaGfaauggaGfaGfagugcscsa | 1167 |
| AD-1230772 | gsgsuga(Chd)GfuGfGfUfagucacuusgsa | 868 | VPusCfsaagUfgacuaccAfcGfucaccsasc | 1168 |
| AD-1230773 | gsusgacg(Uhd)gGfuAfgucacuugsusa | 869 | VPusAfscaaGfugacuacCfaCfgucacscsa | 1169 |
| AD-1230774 | csusagu(Chd)AfcUfGfGfaaauugagsgsa | 870 | VPusCfscucAfauuuccaGfuGfacuagscsa | 1170 |
| AD-1230775 | ascsuggaAfaUfUfGfaggu(Chd)causgsa | 871 | VPusCfsaugGfaccucaaUfuUfccagusgsa | 1171 |
| AD-1230776 | gsasagagAfaAfGfAfugug(Uhd)uususgsa | 872 | VPusCfsaaaAfcacaucuUfuCfucuucscsu | 1172 |
| AD-1230777 | gsasgaaaGfaUfGfUfguuu(Uhd)guususa | 873 | VPusAfsaacAfaaacacaUfcUfuuccucsusu | 1173 |
| AD-1230778 | asasgaug(Uhd)gUfuUfUfuguuuggsasa | 874 | VPusUfsccaAfaacaaaaCfaCfaucuuuscs | 1174 |
| AD-1230779 | ususguu(Uhd)UfgGfAfCfcucucugusgsa | 875 | VPusCfscacAfgagagucCfaAfaacaasasa | 1175 |
| AD-1230780 | usgsuac(Uhd)CfaUfCfUfcagaggaasgsa | 876 | VPusCfsuucCfucugagaUfgAfguacascsc | 1176 |
| AD-1230781 | cscsaagaAfcAfAfUfgaca(Uhd)ugcsgsa | 877 | VPusCfsgcaAfugucauuGfuUfcuuggsusc | 1177 |
| AD-1230782 | gsasacaa(Uhd)gAfCfAfuugcgcugsasa | 878 | VPusUfscagCfgcaaugcUfaUfuguucsusu | 1178 |
| AD-1230783 | usgsaca(Uhd)UfgCfGfCfugaugaagscsa | 879 | VPusGfscuuCfaucagcgCfaAfugucasusu | 1179 |
| AD-1230784 | gsgsagaaAfgGfGfAfagac(Chd)ucasgsa | 880 | VPusCfsugaGfgucuccCfuUfucucscsuc | 1180 |
| AD-1230785 | ususggca(Chd)uCfUfCfugccauucsusa | 881 | VPusAfsgaaUfggcagagAfgUfgccaasasg | 1181 |
| AD-1230786 | csgsaagaAfgAfGfAfaaga(Uhd)gugsusa | 882 | VPusAfscacAfucuuucUfuCfuucgscsc | 1182 |
| AD-1230787 | asasgagaAfaGfAfUfgugu(Uhd)uugsusa | 883 | VPusAfscaaAfacacaucUfuUfcucuuscsu | 1183 |
| AD-1230788 | asgsgc(Uhd)gGfuUfGfCfcaagaaugsasa | 884 | VPusUfscauUfcuugcaaAfcCfagccusgsc | 1184 |
| AD-1230789 | usgscaa(Uhd)CfcCfAfUfuugcaggasusa | 885 | VPusAfsuccUfgcaaaugGfaAfuugcasusg | 1185 |
| AD-1230790 | gscsaau(Chd)CfcAfUfUfugcaggauscsa | 886 | VPusGfsaucCfugcaaauGfgAfauugcsasu | 1186 |
| AD-1230791 | csasugc(Chd)UfcUfGfUfagagagcasgsa | 887 | VPusCfsugcUfcucuacaGfaGfcaugsusg | 1187 |

TABLE 3-continued

Modified Sense and Antisense Strand TMPRSS2 dsRNA Sequences

| | | | | |
|---|---|---|---|---|
| AD-1230792 | uscsugggAfuAfGfAfgug(Chd)gacucusca | 888 | VPusGfsaguCfgcacucuAfuCfccagasgsu | 1188 |
| AD-1230793 | ascsuca(Uhd)CfuCfAfGfaggaagucscsa | 889 | VPusGfsgacUfccucugAfgAfugagusasc | 1189 |
| AD-1230794 | ascsgac(Uhd)GfgAfAfCfgagaacuascsa | 890 | VPusGfsuagUfcucguuCfcAfgucguscsu | 1190 |
| AD-1230795 | ususuuua(Chd)uCfUfAfgccaaggasasa | 891 | VPusUfsuccUfggcuagAfgUfaaaaasusu | 1191 |
| AD-1230796 | ususacu(Chd)UfaGfCfCfaaggaauasgsa | 892 | VPusCfsuauUfccuggcUfaGfaguaasasa | 1192 |
| AD-1230797 | ascsugua(Chd)cAfCfAfgugaugccsusa | 893 | VPusAfsggcAfucacuguGfgUfacagususu | 1193 |
| AD-1230798 | ascsca(Chd)aGfuGfAfUfgccguucsusa | 894 | VPusAfsgaaCfaggcaucAfcUfgugugusasc | 1194 |
| AD-1230799 | ascsaa(Chd)gAfcAfUfUfgcgcugausgsa | 895 | VPusCfsaucAfgcgcaauGfuCfauugususc | 1195 |
| AD-1230800 | asusgaca(Uhd)uGfCfGfcugaugaasgsa | 896 | VPusCfsuucAfucagcgcAfaUfgucausug | 1196 |
| AD-1230801 | cscsaggaGfuGfUfAfcgggaa(Uhd)gsusa | 897 | VPusAfscauUfcccguacAfcUfccuggsusc | 1197 |
| AD-1230802 | usasuuca(Chd)gGfAfCfuggauuuasusa | 898 | VPusAfsuaaAfuccagucCfgUfgaauascsc | 1198 |
| AD-1230803 | gsasuuua(Uhd)cGfAfCfaaaugaggsgsa | 899 | VPusCfsccuCfauuugucGfaUfaaaucscsa | 1199 |
| AD-1230804 | asgsaga(Uhd)GfaUfUfCfagaggucascsa | 900 | VPusGfsugaCfcucugaaUfcAfucucusasa | 1200 |
| AD-1230805 | asgsagaaAfgAfUfGfuguu(Uhd)ugususa | 901 | VPusAfsacaAfaacacauCfuUfucucususc | 1201 |
| AD-1230806 | csasagug(Chd)cAfUfAfaccaugagscsa | 902 | VPusGfscucAfugguuauGfgCfacuugsgsc | 1202 |
| AD-1230807 | csasuaa(Chd)CfaUfGfAfgcacuacscsa | 903 | VPusGfsaguAfgugcucaUfgGfuuaugsgsc | 1203 |
| AD-1230808 | csasuuug(Chd)aGfGfAfucuguucusgsa | 904 | VPusAfscagAfcagauccUfgCfaaaugsgsg | 1204 |
| AD-1230809 | uscsauc(Uhd)CfaGfAfGfgaaguccusgsa | 905 | VPusCfsaggAfcuuccucUfgAfgaugasgsu | 1205 |
| AD-1230810 | csasggag(Uhd)gUfAfCfgggaaugusgsa | 906 | VPusCfsacaUfucccguaCfaCfuccugsgsu | 1206 |
| AD-1230811 | uscsugg(Chd)UfuUfGfGfcacucucsgsa | 907 | VPusCfsagaGfagugccaAfaGfccagascsa | 1207 |
| AD-1230812 | usgsgca(Chd)UfcUfCfUfgccauucsgsa | 908 | VPusCfsagaAfuggcagAfaGfugccasasa | 1208 |
| AD-1230813 | gsgscac(Uhd)CfuCfUfGfccauucgsusa | 909 | VPusAfscagAfuggcagAfgAfugccsasa | 1209 |
| AD-1230814 | ascsca(Uhd)gGfaUfAfCfcaaccggasasa | 910 | VPusUfsuccGfguugguaUfcCfauggususu | 1210 |
| AD-1230815 | cscsauggAfuAfCfCfaac(Chd)ggaasasa | 911 | VPusUfsuucCfgguugguAfuCfcauggsusu | 1211 |
| AD-1230816 | gsgsaaa(Uhd)cAfAfGfgaugcucasgsa | 912 | VPusCfsugaGfcauccuuGfaUfuuccscsc | 1212 |
| AD-1230817 | cscsaag(Uhd)GfcCfAfUfaaccaugasgsa | 913 | VPusCfsucaUfgguuauGfcAfcuuggscsa | 1213 |
| AD-1230818 | csasug(Chd)aAfuCfCfCfauuugcagsgsa | 914 | VPusCfscugCfaaaugggAfuUfgcaugsasc | 1214 |
| AD-1230819 | cscsauu(Uhd)GfcAfGfGfaucugucusgsa | 915 | VPusCfsagaCfagauccUfgCfaauggsgsa | 1215 |
| AD-1230820 | usgscaggAfuCfUfGfucug(Uhd)gcascsa | 916 | VPusGfsugcAfcagacagAfuCfcugcasasa | 1216 |

| Duplex Name | mRNA target sequence 5' to 3' | SEQ ID NO: |
|---|---|---|
| AD-1230521 | CCUUCAUUUAACUCUUUGAAACU | 1217 |
| AD-1230522 | GAAAACGUCUUCCUUCUUUAUUG | 1218 |
| AD-1230523 | AAAACGUCUUCCUUCUUUAUUGC | 1219 |
| AD-1230524 | AAUGGUGAAAACGUCUUCCUUCU | 1220 |
| AD-1230525 | AGUGGUUUCUUUACGCUGUAUAG | 1221 |
| AD-1230526 | CAUUCCAGAUACCUAUCAUUACU | 1222 |
| AD-1230527 | AUUCCAGAUACCUAUCAUUACUC | 1223 |
| AD-1230528 | UCCAGAUACCUAUCAUUACUCGA | 1224 |

TABLE 3-continued

Modified Sense and Antisense Strand TMPRSS2 dsRNA Sequences

| | | |
|---|---|---|
| AD-1230529 | CAGAUACCUAUCAUUACUCGAUG | 1225 |
| AD-1230530 | UGCGUGGAAAAACCUCUUAACAA | 1226 |
| AD-1230531 | AAAGUGAUUUCUCAUCCAAAUUA | 1227 |
| AD-1230532 | UUUCUCAUCCAAAUUAUGACUCC | 1228 |
| AD-1230533 | UCAUCCAAAUUAUGACUCCAAGA | 1229 |
| AD-1230534 | GGACUGGAUUUAUCGACAAAUGA | 1230 |
| AD-1230535 | CUUUUGAUGUCUCCAAGUAGUCC | 1231 |
| AD-1230536 | CCCAAGACACAUCCUAAAAGGUG | 1232 |
| AD-1230537 | UUGUAAUGGUGAAAACGUCUUCC | 1233 |
| AD-1230538 | GGUGAAAACGUCUUCCUUCUUUA | 1234 |
| AD-1230539 | GUGAAAACGUCUUCCUUCUUUAU | 1235 |
| AD-1230540 | UAAACUGUAAAGUUCAAUUGUGA | 1236 |
| AD-1230541 | GUGUACUCAUCUCAGAGGAAGUC | 1237 |
| AD-1230542 | GCCGGCAAUGUCGAUAUCUAUAA | 1238 |
| AD-1230543 | CCGGCAAUGUCGAUAUCUAUAAA | 1239 |
| AD-1230544 | CGGCAAUGUCGAUAUCUAUAAAA | 1240 |
| AD-1230545 | GGCAAUGUCGAUAUCUAUAAAAA | 1241 |
| AD-1230546 | CAGUGGUUUCUUUACGCUGUAUA | 1242 |
| AD-1230547 | ACAUUCCAGAUACCUAUCAUUAC | 1243 |
| AD-1230548 | UUCCAGAUACCUAUCAUUACUCG | 1244 |
| AD-1230549 | CCAGAUACCUAUCAUUACUCGAU | 1245 |
| AD-1230550 | AAGUGAUUUCUCAUCCAAAUUAU | 1246 |
| AD-1230551 | AGUGAUUUCUCAUCCAAAUUAUG | 1247 |
| AD-1230552 | UGAUUUCUCAUCCAAAUUAUGAC | 1248 |
| AD-1230553 | GAUUUCUCAUCCAAAUUAUGACU | 1249 |
| AD-1230554 | AUUUCUCAUCCAAAUUAUGACUC | 1250 |
| AD-1230555 | AGAGGUCACUUCAUUUUUAUUAA | 1251 |
| AD-1230556 | UUAUGUUUCUACACAUUGCUACC | 1252 |
| AD-1230557 | CUUCAUUUAACUCUUUGAAACUG | 1253 |
| AD-1230558 | AGCUAGGACUUAACCUUGAAAUG | 1254 |
| AD-1230559 | CAAGACACAUCCUAAAAGGUGUU | 1255 |
| AD-1230560 | AAGACACAUCCUAAAAGGUGUUG | 1256 |
| AD-1230561 | UAAUGGUGAAAACGUCUUCCUUC | 1257 |
| AD-1230562 | UGGUGAAAACGUCUUCCUUCUUU | 1258 |
| AD-1230563 | UGAAAACGUCUUCCUUCUUUAUU | 1259 |
| AD-1230564 | UGAUGCCUGUUCUUCAAAAGCAG | 1260 |
| AD-1230565 | AUGCCUGUUCUUCAAAAGCAGUG | 1261 |
| AD-1230566 | UCUUCAAAAGCAGUGGUUUCUUU | 1262 |
| AD-1230567 | ACCUAUCAUUACUCGAUGCUGUU | 1263 |

TABLE 3-continued

Modified Sense and Antisense Strand TMPRSS2 dsRNA Sequences

| | | |
|---|---|---|
| AD-1230568 | ACUGCGUGGAAAAACCUCUUAAC | 1264 |
| AD-1230569 | ACCAAGUAGAAAAAGUGAUUUCU | 1265 |
| AD-1230570 | CCAAGUAGAAAAAGUGAUUUCUC | 1266 |
| AD-1230571 | AAGUAGAAAAGUGAUUUCUCAU | 1267 |
| AD-1230572 | AGUAGAAAAGUGAUUUCUCAUC | 1268 |
| AD-1230573 | GAAAAAGUGAUUUCUCAUCCAAA | 1269 |
| AD-1230574 | GUGAUUUCUCAUCCAAAUUAUGA | 1270 |
| AD-1230575 | AGAAGCCUCUGACUUUCAACGAC | 1271 |
| AD-1230576 | CUGCUAGUCACUGGAAAUUGAGG | 1272 |
| AD-1230577 | GCUUUUGAUGUCUCCAAGUAGUC | 1273 |
| AD-1230578 | AAGAUGUGUUUUGUUUUGGACUC | 1274 |
| AD-1230579 | UGUUUUGUUUUGGACUCUCUGUG | 1275 |
| AD-1230580 | AGGCUGGUUUGCAAGAAUGAAAU | 1276 |
| AD-1230581 | GCUGGUUUGCAAGAAUGAAAUGA | 1277 |
| AD-1230582 | CUGGUUUGCAAGAAUGAAAUGAA | 1278 |
| AD-1230583 | GCUAGGACUUAACCUUGAAAUGG | 1279 |
| AD-1230584 | AUGGUGAAAACGUCUUCCUUCUU | 1280 |
| AD-1230585 | AAACGUCUUCCUUCUUUAUUGCC | 1281 |
| AD-1230586 | AACGUCUUCCUUCUUUAUUGCCC | 1282 |
| AD-1230587 | AACUGUAAAGUUCAAUUGUGAAA | 1283 |
| AD-1230588 | GUGCACCUCAAAGACUAAGAAAG | 1284 |
| AD-1230589 | UGCACCUCAAAGACUAAGAAAGC | 1285 |
| AD-1230590 | GGAUCCACCAGCUUUAUGAAACU | 1286 |
| AD-1230591 | AGUGAUGCCUGUUCUUCAAAAGC | 1287 |
| AD-1230592 | GUGAUGCCUGUUCUUCAAAAGCA | 1288 |
| AD-1230593 | GAUGCCUGUUCUUCAAAAGCAGU | 1289 |
| AD-1230594 | GUUCUUCAAAAGCAGUGGUUUCU | 1290 |
| AD-1230595 | AACAUUCCAGAUACCUAUCAUUA | 1291 |
| AD-1230596 | AUACCUAUCAUUACUCGAUGCUG | 1292 |
| AD-1230597 | CUGCGUGGAAAAACCUCUUAACA | 1293 |
| AD-1230598 | AUCAUUACUCGAUGCUGUUGAUA | 1294 |
| AD-1230599 | CAUUACUCGAUGCUGUUGAUAAC | 1295 |
| AD-1230600 | CCAAGAACAAUGACAUUGCGCUG | 1296 |
| AD-1230601 | UAACAGCAAGAUGGCUUUGAACU | 1297 |
| AD-1230602 | AACAGCAAGAUGGCUUUGAACUC | 1298 |
| AD-1230603 | AUUCAGAGGUCACUUCAUUUUUA | 1299 |
| AD-1230604 | UUCAGAGGUCACUUCAUUUUUAU | 1300 |
| AD-1230605 | CAUGUUAUGUUUCUACACAUUGC | 1301 |
| AD-1230606 | GUUAUGUUUCUACACAUUGCUAC | 1302 |

TABLE 3-continued

Modified Sense and Antisense Strand TMPRSS2 dsRNA Sequences

| | | |
|---|---|---|
| AD-1230607 | UAACGUUCUAUAAAUGAAUGUGC | 1303 |
| AD-1230608 | GUGUUUUGUUUUGGACUCUCUGU | 1304 |
| AD-1230609 | UGGUUUGCAAGAAUGAAAUGAAU | 1305 |
| AD-1230610 | GCAAGAAUGAAAUGAAUGAUUCU | 1306 |
| AD-1230611 | CAGCUAGGACUUAACCUUGAAAU | 1307 |
| AD-1230612 | CCAAGACACAUCCUAAAAGGUGU | 1308 |
| AD-1230613 | GUUGUAAUGGUGAAAACGUCUUC | 1309 |
| AD-1230614 | GUAAUGGUGAAAACGUCUUCCUU | 1310 |
| AD-1230615 | AAACUGUAAAGUUCAAUUGUGAA | 1311 |
| AD-1230616 | ACUGUAAAGUUCAAUUGUGAAAA | 1312 |
| AD-1230617 | GCACCUCAAAGACUAAGAAAGCA | 1313 |
| AD-1230618 | CACCUCAAAGACUAAGAAAGCAC | 1314 |
| AD-1230619 | ACCUCAAAGACUAAGAAAGCACU | 1315 |
| AD-1230620 | UCCACCAGCUUUAUGAAACUGAA | 1316 |
| AD-1230621 | UGCCGGCAAUGUCGAUAUCUAUA | 1317 |
| AD-1230622 | CUGUUCUUCAAAAGCAGUGGUUU | 1318 |
| AD-1230623 | UUCUUCAAAAGCAGUGGUUUCUU | 1319 |
| AD-1230624 | UAUUGAACAUUCCAGAUACCUAU | 1320 |
| AD-1230625 | GAACAUUCCAGAUACCUAUCAUU | 1321 |
| AD-1230626 | UAUCAUUACUCGAUGCUGUUGAU | 1322 |
| AD-1230627 | CAAGUAGAAAAGUGAUUUCUCA | 1323 |
| AD-1230628 | GACUCCAAGACCAAGAACAAUGA | 1324 |
| AD-1230629 | UCCAAGACCAAGAACAAUGACAU | 1325 |
| AD-1230630 | AGCAAGAUGGCUUUGAACUCAGG | 1326 |
| AD-1230631 | GUGACGUGGUAGUCACUUGUAAG | 1327 |
| AD-1230632 | AUGUUAUGUUUCUACACAUUGCU | 1328 |
| AD-1230633 | GGUUUGCAAGAAUGAAAUGAAUG | 1329 |
| AD-1230634 | CUAGGACUUAACCUUGAAAUGGA | 1330 |
| AD-1230635 | AUUGUGAAAAUGAAUAUCAUGCA | 1331 |
| AD-1230636 | ACAGUGAUGCCUGUUCUUCAAAA | 1332 |
| AD-1230637 | UGUUCUUCAAAAGCAGUGGUUUC | 1333 |
| AD-1230638 | CUUCAAAAGCAGUGGUUUCUUUA | 1334 |
| AD-1230639 | UUCAAAAGCAGUGGUUUCUUUAC | 1335 |
| AD-1230640 | GUGGUUUCUUUACGCUGUAUAGC | 1336 |
| AD-1230641 | AGAUACCUAUCAUUACUCGAUGC | 1337 |
| AD-1230642 | CUAUCAUUACUCGAUGCUGUUGA | 1338 |
| AD-1230643 | AGAAAAAGUGAUUUCUCAUCCAA | 1339 |
| AD-1230644 | UGACUCCAAGACCAAGAACAAUG | 1340 |
| AD-1230645 | CUCCAAGACCAAGAACAAUGACA | 1341 |

TABLE 3-continued

Modified Sense and Antisense Strand TMPRSS2 dsRNA Sequences

| | | |
|---|---|---|
| AD-1230646 | CCAAGACCAAGAACAAUGACAUU | 1342 |
| AD-1230647 | GACUGGAUUUAUCGACAAAUGAG | 1343 |
| AD-1230648 | GAUUCAGAGGUCACUUCAUUUUU | 1344 |
| AD-1230649 | UCAGAGGUCACUUCAUUUUUAUU | 1345 |
| AD-1230650 | CAGAGGUCACUUCAUUUUUAUUA | 1346 |
| AD-1230651 | GGGGAACAGAAACAUUUUUGUUC | 1347 |
| AD-1230652 | CCUGCUAGUCACUGGAAAUUGAG | 1348 |
| AD-1230653 | UGUUAUGUUUCUACACAUUGCUA | 1349 |
| AD-1230654 | AGCUUUUGAUGUCUCCAAGUAGU | 1350 |
| AD-1230655 | UUUGAUGUCUCCAAGUAGUCCAC | 1351 |
| AD-1230656 | CGUUCUAUAAAUGAAUGUGCUGA | 1352 |
| AD-1230657 | CAAGAAUGAAAUGAAUGAUUCUA | 1353 |
| AD-1230658 | AGAAUGAAAUGAAUGAUUCUACA | 1354 |
| AD-1230659 | UAGGACUUAACCUUGAAAUGGAA | 1355 |
| AD-1230660 | AGGACUUAACCUUGAAAUGGAAA | 1356 |
| AD-1230661 | AAAGUCAUGCAAUCCCAUUUGCA | 1357 |
| AD-1230662 | AAGUCAUGCAAUCCCAUUUGCAG | 1358 |
| AD-1230663 | GUGUGCACCUCAAAGACUAAGAA | 1359 |
| AD-1230664 | GAUCCACCAGCUUUAUGAAACUG | 1360 |
| AD-1230665 | CCAGCUUUAUGAAACUGAACACA | 1361 |
| AD-1230666 | UUAUGAAACUGAACACAAGUGCC | 1362 |
| AD-1230667 | AUAUUGAACAUUCCAGAUACCUA | 1363 |
| AD-1230668 | UCAAAAGCAGUGGUUUCUUUACG | 1364 |
| AD-1230669 | UGGUUUCUUUACGCUGUAUAGCC | 1365 |
| AD-1230670 | UCAUUACUCGAUGCUGUUGAUAA | 1366 |
| AD-1230671 | AAGACCAAGAACAAUGACAUUGC | 1367 |
| AD-1230672 | AGACCAAGAACAAUGACAUUGCG | 1368 |
| AD-1230673 | ACAGCAAGAUGGCUUUGAACUCA | 1369 |
| AD-1230674 | UUCACGGACUGGAUUUAUCGACA | 1370 |
| AD-1230675 | UCACGGACUGGAUUUAUCGACAA | 1371 |
| AD-1230676 | ACUGGAUUUAUCGACAAAUGAGG | 1372 |
| AD-1230677 | UGACGUGGUAGUCACUUGUAAGG | 1373 |
| AD-1230678 | GCUAGUCACUGGAAAUUGAGGUC | 1374 |
| AD-1230679 | GGAAAUCAAGGAUGCUCAGUUUA | 1375 |
| AD-1230680 | GUUCUAUAAAUGAAUGUGCUGAA | 1376 |
| AD-1230681 | UCUAUAAAUGAAUGUGCUGAAGC | 1377 |
| AD-1230682 | GUUUUGUUUUGGACUCUCUGUGG | 1378 |
| AD-1230683 | CAGGCUGGUUUGCAAGAAUGAAA | 1379 |
| AD-1230684 | ACAGCUAGGACUUAACCUUGAAA | 1380 |

TABLE 3-continued

Modified Sense and Antisense Strand TMPRSS2 dsRNA Sequences

| | | |
|---|---|---|
| AD-1230685 | AAUCCCAUUUGCAGGAUCUGUCU | 1381 |
| AD-1230686 | GUAAAGUUCAAUUGUGAAAAUGA | 1382 |
| AD-1230687 | UGUGCACCUCAAAGACUAAGAAA | 1383 |
| AD-1230688 | UCAAAGACUAAGAAAGCACUGUG | 1384 |
| AD-1230689 | UUCAGGUGUACUCAUCUCAGAGG | 1385 |
| AD-1230690 | UUACUCUAGCCAAGGAAUAGUGG | 1386 |
| AD-1230691 | CACAGUGAUGCCUGUUCUUCAAA | 1387 |
| AD-1230692 | CAAAAGCAGUGGUUUCUUUACGC | 1388 |
| AD-1230693 | AAGCAGUGGUUUCUUUACGCUGU | 1389 |
| AD-1230694 | AGCAGUGGUUUCUUUACGCUGUA | 1390 |
| AD-1230695 | UACCUAUCAUUACUCGAUGCUGU | 1391 |
| AD-1230696 | UUAUGACUCCAAGACCAAGAACA | 1392 |
| AD-1230697 | ACUCCAAGACCAAGAACAAUGAC | 1393 |
| AD-1230698 | UAUUCACGGACUGGAUUUAUCGA | 1394 |
| AD-1230699 | GAUGAUUCAGAGGUCACUUCAUU | 1395 |
| AD-1230700 | AUGAUUCAGAGGUCACUUCAUUU | 1396 |
| AD-1230701 | UGAUUCAGAGGUCACUUCAUUUU | 1397 |
| AD-1230702 | CUAGUCACUGGAAAUUGAGGUCC | 1398 |
| AD-1230703 | AUGUUUCUACACAUUGCUACCUC | 1399 |
| AD-1230704 | UGUUUCUACACAUUGCUACCUCA | 1400 |
| AD-1230705 | UUUUGAUGUCUCCAAGUAGUCCA | 1401 |
| AD-1230706 | ACGUUCUAUAAAUGAAUGUGCUG | 1402 |
| AD-1230707 | UUUGUUUUGGACUCUCUGUGGUC | 1403 |
| AD-1230708 | CAUAACCAUGAGCACUACUCUAC | 1404 |
| AD-1230709 | AAGCAGGCUGGUUUGCAAGAAUG | 1405 |
| AD-1230710 | UGCAAGAAUGAAAUGAAUGAUUC | 1406 |
| AD-1230711 | CAAAGACUAAGAAAGCACUGUGC | 1407 |
| AD-1230712 | UCCUUCAGGUGUACUCAUCUCAG | 1408 |
| AD-1230713 | CCUUCAGGUGUACUCAUCUCAGA | 1409 |
| AD-1230714 | AUCCACCAGCUUUAUGAAACUGA | 1410 |
| AD-1230715 | AAAAGCAGUGGUUUCUUUACGCU | 1411 |
| AD-1230716 | AAAGCAGUGGUUUCUUUACGCUG | 1412 |
| AD-1230717 | ACCAAGAACAAUGACAUUGCGCU | 1413 |
| AD-1230718 | CACGGACUGGAUUUAUCGACAAA | 1414 |
| AD-1230719 | CUGGAUUUAUCGACAAAUGAGGG | 1415 |
| AD-1230720 | GGUGACGUGGUAGUCACUUGUAA | 1416 |
| AD-1230721 | AACGUUCUAUAAAUGAAUGUGCU | 1417 |
| AD-1230722 | AGAGAAAGAUGUGUUUUGUUUUG | 1418 |
| AD-1230723 | GAGAAAGAUGUGUUUUGUUUUGG | 1419 |

TABLE 3-continued

Modified Sense and Antisense Strand TMPRSS2 dsRNA Sequences

| | | |
|---|---|---|
| AD-1230724 | AAAGAUGUGUUUUGUUUUGGACU | 1420 |
| AD-1230725 | GUUUGCAAGAAUGAAAUGAAUGA | 1421 |
| AD-1230726 | UUUGCAAGAAUGAAAUGAAUGAU | 1422 |
| AD-1230727 | UUGCAAGAAUGAAAUGAAUGAUU | 1423 |
| AD-1230728 | GAAAGUCAUGCAAUCCCAUUUGC | 1424 |
| AD-1230729 | CAAUCCCAUUUGCAGGAUCUGUC | 1425 |
| AD-1230730 | CCUCUGUAGAGAGCAGCAUUCCC | 1426 |
| AD-1230731 | UGUAAUGGUGAAAACGUCUUCCU | 1427 |
| AD-1230732 | UUGUGAAAAUGAAUAUCAUGCAA | 1428 |
| AD-1230733 | UGUGAAAAUGAAUAUCAUGCAAA | 1429 |
| AD-1230734 | AUCCUUCAGGUGUACUCAUCUCA | 1430 |
| AD-1230735 | GACGACUGGAACGAGAACUACGG | 1431 |
| AD-1230736 | CAGGGACAUGGGCUAUAAGAAUA | 1432 |
| AD-1230737 | AUUUUUACUCUAGCCAAGGAAUA | 1433 |
| AD-1230738 | UUUACUCUAGCCAAGGAAUAGUG | 1434 |
| AD-1230739 | UUUAUGAAACUGAACACAAGUGC | 1435 |
| AD-1230740 | GAUACCUAUCAUUACUCGAUGCU | 1436 |
| AD-1230741 | GUAUUCACGGACUGGAUUUAUCG | 1437 |
| AD-1230742 | AUUCACGGACUGGAUUUAUCGAC | 1438 |
| AD-1230743 | CUAUGAAAACCAUGGAUACCAAC | 1439 |
| AD-1230744 | GACGUGGUAGUCACUUGUAAGGG | 1440 |
| AD-1230745 | CGGCGAAGAAGAGAAAGAUGUGU | 1441 |
| AD-1230746 | GCGAAGAAGAGAAAGAUGUGUUU | 1442 |
| AD-1230747 | CGAAGAAGAGAAAGAUGUGUUUU | 1443 |
| AD-1230748 | GAAGAAGAGAAAGAUGUGUUUUG | 1444 |
| AD-1230749 | CCAUAACCAUGAGCACUACUCUA | 1445 |
| AD-1230750 | AGCAGGCUGGUUUGCAAGAAUGA | 1446 |
| AD-1230751 | AGUCAUGCAAUCCCAUUUGCAGG | 1447 |
| AD-1230752 | AUCCCAUUUGCAGGAUCUGUCUG | 1448 |
| AD-1230753 | UACUCAUCUCAGAGGAAGUCCUG | 1449 |
| AD-1230754 | AAGACGACUGGAACGAGAACUAC | 1450 |
| AD-1230755 | CUCUAGCCAAGGAAUAGUGGAUG | 1451 |
| AD-1230756 | AAAAACUGUACCACAGUGAUGCC | 1452 |
| AD-1230757 | ACCACAGUGAUGCCUGUUCUUCA | 1453 |
| AD-1230758 | AGAACAAUGACAUUGCGCUGAUG | 1454 |
| AD-1230759 | AACAAUGACAUUGCGCUGAUGAA | 1455 |
| AD-1230760 | AGAAAGAUGUGUUUUGUUUUGGA | 1456 |
| AD-1230761 | AUUGCCAAGUGCCAUAACCAUGA | 1457 |
| AD-1230762 | AGUGUGCACCUCAAAGACUAAGA | 1458 |

TABLE 3-continued

Modified Sense and Antisense Strand TMPRSS2 dsRNA Sequences

| | | |
|---|---|---|
| AD-1230763 | AAAGACUAAGAAAGCACUGUGCA | 1459 |
| AD-1230764 | UCAGGUGUACUCAUCUCAGAGGA | 1460 |
| AD-1230765 | UACCACAGUGAUGCCUGUUCUUC | 1461 |
| AD-1230766 | CCACAGUGAUGCCUGUUCUUCAA | 1462 |
| AD-1230767 | CCUGUUCUUCAAAAGCAGUGGUU | 1463 |
| AD-1230768 | CAAGAACAAUGACAUUGCGCUGA | 1464 |
| AD-1230769 | GCAAGAUGGCUUUGAACUCAGGG | 1465 |
| AD-1230770 | AAGAUGGCUUUGAACUCAGGGUC | 1466 |
| AD-1230771 | UGGCACUCUCUGCCAUUCUGUGC | 1467 |
| AD-1230772 | GUGGUGACGUGGUAGUCACUUGU | 1468 |
| AD-1230773 | UGGUGACGUGGUAGUCACUUGUA | 1469 |
| AD-1230774 | UGCUAGUCACUGGAAAUUGAGGU | 1470 |
| AD-1230775 | UCACUGGAAAUUGAGGUCCAUGG | 1471 |
| AD-1230776 | AAGAAGAGAAAGAUGUGUUUUGU | 1472 |
| AD-1230777 | AAGAGAAAGAUGUGUUUUGUUUU | 1473 |
| AD-1230778 | GAAAGAUGUGUUUUGUUUUGGAC | 1474 |
| AD-1230779 | UUUUGUUUUGGACUCUCUGUGGU | 1475 |
| AD-1230780 | GGUGUACUCAUCUCAGAGGAAGU | 1476 |
| AD-1230781 | GACCAAGAACAAUGACAUUGCGC | 1477 |
| AD-1230782 | AAGAACAAUGACAUUGCGCUGAU | 1478 |
| AD-1230783 | AAUGACAUUGCGCUGAUGAAGCU | 1479 |
| AD-1230784 | GAGGAGAAAGGGAAGACCUCAGA | 1480 |
| AD-1230785 | CUUUGGCACUCUCUGCCAUUCUG | 1481 |
| AD-1230786 | GGCGAAGAAGAGAAAGAUGUGUU | 1482 |
| AD-1230787 | AGAAGAGAAAGAUGUGUUUUGUU | 1483 |
| AD-1230788 | GCAGGCUGGUUUGCAAGAAUGAA | 1484 |
| AD-1230789 | CAUGCAAUCCCAUUUGCAGGAUC | 1485 |
| AD-1230790 | AUGCAAUCCCAUUUGCAGGAUCU | 1486 |
| AD-1230791 | CACAUGCCUCUGUAGAGAGCAGC | 1487 |
| AD-1230792 | ACUCUGGGAUAGAGUGCGACUCC | 1488 |
| AD-1230793 | GUACUCAUCUCAGAGGAAGUCCU | 1489 |
| AD-1230794 | AGACGACUGGAACGAGAACUACG | 1490 |
| AD-1230795 | AAUUUUUACUCUAGCCAAGGAAU | 1491 |
| AD-1230796 | UUUUACUCUAGCCAAGGAAUAGU | 1492 |
| AD-1230797 | AAACUGUACCACAGUGAUGCCUG | 1493 |
| AD-1230798 | GUACCACAGUGAUGCCUGUUCUU | 1494 |
| AD-1230799 | GAACAAUGACAUUGCGCUGAUGA | 1495 |
| AD-1230800 | CAAUGACAUUGCGCUGAUGAAGC | 1496 |
| AD-1230801 | GACCAGGAGUGUACGGGAAUGUG | 1497 |

TABLE 3-continued

Modified Sense and Antisense Strand TMPRSS2 dsRNA Sequences

| | | |
|---|---|---|
| AD-1230802 | GGUAUUCACGGACUGGAUUUAUC | 1498 |
| AD-1230803 | UGGAUUUAUCGACAAAUGAGGGC | 1499 |
| AD-1230804 | UUAGAGAUGAUUCAGAGGUCACU | 1500 |
| AD-1230805 | GAAGAGAAAGAUGUGUUUUGUUU | 1501 |
| AD-1230806 | GCCAAGUGCCAUAACCAUGAGCA | 1502 |
| AD-1230807 | GCCAUAACCAUGAGCACUACUCU | 1503 |
| AD-1230808 | CCCAUUUGCAGGAUCUGUCUGUG | 1504 |
| AD-1230809 | ACUCAUCUCAGAGGAAGUCCUGG | 1505 |
| AD-1230810 | ACCAGGAGUGUACGGGAAUGUGA | 1506 |
| AD-1230811 | UGUCUGGCUUUGGCACUCUCUGC | 1507 |
| AD-1230812 | UUUGGCACUCUCUGCCAUUCUGU | 1508 |
| AD-1230813 | UUGGCACUCUCUGCCAUUCUGUG | 1509 |
| AD-1230814 | AAACCAUGGAUACCAACCGGAAA | 1510 |
| AD-1230815 | AACCAUGGAUACCAACCGGAAAA | 1511 |
| AD-1230816 | GGGGGAAAUCAAGGAUGCUCAGU | 1512 |
| AD-1230817 | UGCCAAGUGCCAUAACCAUGAGC | 1513 |
| AD-1230818 | GUCAUGCAAUCCCAUUUGCAGGA | 1514 |
| AD-1230819 | UCCCAUUUGCAGGAUCUGUCUGU | 1515 |
| AD-1230820 | UUUGCAGGAUCUGUCUGUGCACA | 1516 |

TABLE 4

TMPRSS2 Single Dose Screens in PHH cells

| Duplex ID | 10 nM Avg | SD | 1 nM Avg | SD | 0.1 nM Avg | SD |
|---|---|---|---|---|---|---|
| AD-1230667.1 | 20.4 | 5.1 | 32.9 | 12.3 | 42.5 | 11.3 |
| AD-1230624.1 | 14.7 | 5.8 | 24.3 | 4.8 | 22.1 | 1.5 |
| AD-1230625.1 | 14.3 | 1.1 | 19.6 | 3.5 | 23.2 | 10.1 |
| AD-1230595.1 | 17.3 | 4.8 | 22.3 | 4.5 | 31.9 | 1.7 |
| AD-1230547.1 | 17.6 | 3.0 | 27.4 | 6.8 | 41.0 | 5.2 |
| AD-1230526.1 | 7.9 | 2.0 | 17.0 | 2.6 | 22.7 | 6.9 |
| AD-1230527.1 | 6.6 | 1.2 | 13.4 | 1.1 | 18.6 | 3.8 |
| AD-1230548.1 | 17.2 | 4.7 | 19.7 | 3.0 | 41.6 | 11.0 |
| AD-1230528.1 | 10.5 | 2.3 | 30.1 | 9.0 | 23.0 | 6.2 |
| AD-1230549.1 | 20.4 | 6.6 | 20.4 | 6.4 | 36.1 | 12.3 |
| AD-1230529.1 | 18.3 | 2.4 | 34.9 | 5.2 | 39.0 | 3.9 |
| AD-1230641.1 | 33.3 | 8.1 | 67.4 | 9.3 | 52.9 | 7.4 |
| AD-1230740.1 | 68.6 | 3.3 | 74.5 | 8.3 | 85.9 | 9.3 |
| AD-1230596.1 | 15.2 | 4.6 | 26.3 | 8.0 | 41.5 | 6.7 |
| AD-1230695.1 | 14.9 | 3.8 | 18.4 | 4.4 | 40.6 | 6.7 |
| AD-1230567.1 | 30.6 | 2.3 | 53.5 | 15.9 | 58.3 | 22.4 |
| AD-1230642.1 | 49.5 | 23.9 | 75.1 | 17.2 | 82.4 | 12.0 |
| AD-1230626.1 | 15.8 | 0.7 | 18.7 | 5.9 | 35.7 | 6.8 |
| AD-1230598.1 | 30.1 | 1.2 | 42.9 | 9.9 | 59.1 | 5.3 |
| AD-1230670.1 | 26.6 | 2.6 | 22.9 | 3.7 | 31.6 | 11.8 |
| AD-1230599.1 | 19.3 | 4.1 | 30.8 | 4.2 | 58.1 | 11.5 |
| AD-1230601.1 | 38.5 | 6.3 | 56.4 | 12.8 | 52.5 | 8.7 |
| AD-1230602.1 | 16.3 | 4.4 | 22.0 | 2.8 | 31.9 | 10.7 |
| AD-1230673.1 | 20.3 | 3.2 | 34.8 | 15.4 | 49.1 | 10.3 |
| AD-1230630.1 | 25.9 | 5.9 | 32.5 | 9.2 | 40.4 | 6.6 |
| AD-1230769.1 | 57.4 | 2.0 | 71.0 | 14.9 | 82.6 | 7.1 |
| AD-1230770.1 | 47.1 | 3.1 | 63.5 | 7.4 | 65.0 | 5.5 |
| AD-1230743.1 | 49.9 | 6.6 | 46.1 | 2.5 | 71.7 | 10.1 |
| AD-1230814.1 | 60.8 | 12.2 | 61.9 | 4.2 | 49.9 | 5.3 |
| AD-1230815.1 | 69.4 | 11.6 | 103.0 | 31.5 | 85.2 | 12.4 |
| AD-1230762.1 | 53.5 | 6.4 | 59.0 | 5.2 | 64.3 | 4.5 |
| AD-1230663.1 | 25.8 | 1.7 | 23.6 | 4.9 | 43.7 | 15.7 |
| AD-1230687.1 | 45.8 | 4.6 | 65.5 | 18.8 | 82.5 | 8.0 |
| AD-1230588.1 | 30.8 | 3.0 | 24.4 | 11.7 | 61.1 | 6.9 |
| AD-1230589.1 | 26.6 | 4.9 | 53.2 | 3.8 | 48.6 | 14.3 |
| AD-1230617.1 | 23.3 | 3.3 | 29.2 | 8.5 | 27.4 | 5.1 |
| AD-1230618.1 | 26.5 | 5.2 | 27.9 | 8.2 | 32.1 | 13.1 |
| AD-1230619.1 | 35.7 | 5.7 | 53.2 | 11.2 | 51.6 | 8.6 |
| AD-1230688.1 | 20.3 | 7.5 | 25.6 | 2.7 | 44.9 | 11.4 |
| AD-1230711.1 | 27.3 | 8.0 | 25.3 | 5.1 | 43.8 | 5.1 |
| AD-1230763.1 | 70.8 | 14.5 | 83.8 | 29.2 | 80.8 | 13.0 |
| AD-1230792.1 | 87.2 | 14.8 | 50.0 | 7.0 | 101.8 | 16.8 |
| AD-1230734.1 | 34.1 | 2.7 | 30.6 | 5.2 | 56.0 | 10.8 |
| AD-1230712.1 | 17.9 | 1.0 | 19.5 | 5.1 | 31.5 | 14.6 |
| AD-1230713.1 | 21.3 | 3.9 | 24.1 | 5.7 | 34.6 | 6.2 |
| AD-1230689.1 | 24.0 | 7.4 | 34.3 | 14.1 | 50.7 | 19.5 |
| AD-1230764.1 | 39.6 | 11.8 | 53.7 | 12.1 | 60.2 | 4.6 |
| AD-1230780.1 | 37.0 | 5.6 | 41.5 | 11.3 | 71.4 | 7.3 |
| AD-1230541.1 | 45.2 | 11.7 | 45.3 | 13.6 | 60.5 | 11.3 |
| AD-1230793.1 | 91.9 | 11.0 | 54.2 | 13.3 | 103.6 | 22.4 |
| AD-1230753.1 | 105.5 | 55.5 | 74.1 | 22.2 | 112.8 | 36.1 |
| AD-1230809.1 | 71.3 | 10.6 | 70.9 | 2.2 | 76.4 | 16.5 |
| AD-1230754.1 | 32.0 | 3.8 | 50.0 | 11.6 | 83.2 | 29.9 |
| AD-1230794.1 | 48.7 | 5.3 | 37.4 | 3.2 | 65.7 | 11.6 |
| AD-1230735.1 | 41.9 | 6.1 | 38.6 | 3.4 | 61.5 | 6.7 |
| AD-1230736.1 | 36.5 | 6.0 | 42.1 | 5.5 | 67.3 | 12.2 |
| AD-1230795.1 | 50.1 | 3.8 | 38.6 | 6.8 | 48.2 | 5.5 |
| AD-1230737.1 | 37.5 | 8.2 | 38.3 | 8.3 | 47.9 | 17.0 |
| AD-1230796.1 | 56.4 | 8.9 | 42.4 | 2.1 | 61.0 | 18.5 |
| AD-1230738.1 | 37.4 | 8.1 | 32.6 | 4.3 | 68.6 | 25.9 |

TABLE 4-continued

TMPRSS2 Single Dose Screens in PHH cells

| Duplex ID | 10 nM Avg | SD | 1 nM Avg | SD | 0.1 nM Avg | SD |
|---|---|---|---|---|---|---|
| AD-1230690.1 | 63.0 | 12.5 | 53.0 | 7.3 | 73.9 | 13.2 |
| AD-1230755.1 | 42.9 | 7.9 | 64.7 | 9.0 | 74.0 | 15.0 |
| AD-1230590.1 | 17.9 | 3.9 | 27.8 | 7.6 | 52.6 | 4.1 |
| AD-1230664.1 | 44.5 | 8.6 | 77.8 | 12.0 | 102.7 | 15.0 |
| AD-1230714.1 | 38.9 | 4.0 | 46.4 | 8.9 | 50.8 | 6.9 |
| AD-1230620.1 | 19.0 | 6.8 | 39.1 | 7.3 | 41.8 | 6.6 |
| AD-1230665.1 | 29.9 | 9.4 | 49.9 | 6.5 | 64.0 | 13.7 |
| AD-1230739.1 | 79.0 | 12.8 | 67.8 | 7.2 | 108.0 | 21.6 |
| AD-1230666.1 | 24.6 | 8.3 | 43.6 | 8.7 | 60.0 | 6.5 |
| AD-1230621.1 | 36.0 | 4.4 | 64.8 | 6.5 | 62.9 | 17.3 |
| AD-1230542.1 | 9.4 | 3.4 | 24.3 | 3.3 | 35.9 | 3.7 |
| AD-1230543.1 | 8.4 | 3.6 | 12.9 | 4.0 | 21.7 | 6.6 |
| AD-1230544.1 | 23.8 | 1.6 | 56.5 | 5.4 | 58.6 | 8.9 |
| AD-1230545.1 | 12.5 | 2.9 | 36.2 | 11.1 | 40.2 | 15.1 |
| AD-1230756.1 | 32.4 | 3.6 | 45.9 | 4.9 | 70.7 | 6.3 |
| AD-1230797.1 | 46.8 | 5.3 | 42.6 | 8.4 | 67.7 | 12.1 |
| AD-1230798.1 | 28.1 | 1.6 | 41.1 | 9.7 | 57.2 | 14.0 |
| AD-1230765.1 | 84.0 | 7.8 | 99.2 | 11.1 | 75.7 | 12.5 |
| AD-1230757.1 | 17.6 | 7.6 | 19.1 | 2.3 | 24.3 | 6.4 |
| AD-1230766.1 | 16.0 | 1.1 | 22.6 | 7.7 | 33.7 | 6.2 |
| AD-1230691.1 | 16.1 | 3.9 | 23.9 | 2.5 | 40.5 | 6.9 |
| AD-1230636.1 | 26.9 | 5.6 | 39.8 | 13.5 | 47.4 | 9.6 |
| AD-1230591.1 | 36.6 | 4.3 | 49.9 | 8.3 | 66.1 | 14.8 |
| AD-1230592.1 | 23.5 | 3.9 | 41.3 | 8.5 | 60.1 | 12.1 |
| AD-1230564.1 | 16.7 | 5.2 | 33.0 | 14.1 | 52.1 | 11.3 |
| AD-1230593.1 | 26.3 | 6.4 | 33.3 | 6.6 | 63.3 | 10.2 |
| AD-1230565.1 | 27.5 | 6.4 | 40.6 | 16.9 | 73.9 | 4.9 |
| AD-1230767.1 | 32.3 | 4.6 | 35.1 | 1.9 | 50.9 | 5.4 |
| AD-1230622.1 | 54.6 | 12.5 | 77.6 | 25.6 | 78.5 | 21.4 |
| AD-1230637.1 | 40.2 | 8.6 | 54.2 | 18.4 | 67.8 | 8.7 |
| AD-1230594.1 | 23.3 | 3.7 | 35.8 | 12.1 | 49.5 | 11.7 |
| AD-1230623.1 | 29.3 | 12.7 | 42.6 | 8.0 | 48.7 | 6.9 |
| AD-1230566.1 | 24.6 | 5.0 | 43.7 | 8.7 | 61.3 | 13.3 |
| AD-1230638.1 | 35.2 | 6.4 | 42.8 | 6.8 | 57.5 | 20.0 |
| AD-1230639.1 | 14.9 | 3.5 | 26.1 | 8.0 | 44.8 | 8.5 |
| AD-1230668.1 | 21.1 | 7.3 | 28.3 | 5.0 | 40.2 | 7.3 |
| AD-1230692.1 | 12.6 | 1.5 | 16.3 | 3.1 | 28.3 | 1.8 |
| AD-1230715.1 | 32.6 | 4.2 | 24.1 | 1.9 | 37.8 | 1.9 |
| AD-1230716.1 | 22.1 | 3.7 | 22.6 | 4.7 | 43.4 | 11.5 |
| AD-1230693.1 | 18.6 | 4.7 | 22.2 | 4.4 | 42.2 | 11.3 |
| AD-1230694.1 | 18.6 | 2.0 | 23.9 | 6.6 | 36.5 | 10.1 |
| AD-1230546.1 | 47.5 | 6.0 | 76.7 | 15.1 | 95.8 | 8.5 |
| AD-1230525.1 | 16.7 | 4.5 | 24.0 | 5.3 | 33.2 | 6.1 |
| AD-1230640.1 | 31.8 | 7.7 | 50.1 | 14.4 | 88.4 | 27.9 |
| AD-1230669.1 | 27.3 | 6.9 | 35.4 | 3.8 | 56.3 | 7.5 |
| AD-1230568.1 | 26.2 | 3.7 | 48.2 | 4.6 | 51.9 | 15.8 |
| AD-1230597.1 | 20.0 | 3.1 | 43.0 | 7.7 | 44.5 | 9.0 |
| AD-1230530.1 | 17.8 | 0.9 | 43.0 | 9.3 | 52.3 | 11.0 |
| AD-1230569.1 | 13.0 | 2.1 | 20.1 | 5.7 | 32.8 | 12.5 |
| AD-1230570.1 | 11.6 | 1.9 | 23.7 | 5.9 | 30.7 | 9.5 |
| AD-1230627.1 | 15.5 | 2.4 | 35.6 | 12.6 | 34.5 | 4.6 |
| AD-1230571.1 | 18.0 | 4.6 | 15.9 | 5.0 | 36.3 | 5.1 |
| AD-1230572.1 | 11.1 | 4.5 | 21.8 | 6.1 | 32.5 | 13.7 |
| AD-1230643.1 | 26.2 | 3.2 | 36.3 | 11.5 | 43.4 | 9.3 |
| AD-1230573.1 | 11.3 | 5.7 | 21.8 | 3.5 | 27.4 | 9.8 |
| AD-1230531.1 | 18.0 | 4.2 | 38.8 | 13.0 | 48.4 | 7.2 |
| AD-1230550.1 | 13.7 | 1.4 | 19.6 | 9.2 | 34.5 | 5.3 |
| AD-1230551.1 | 33.8 | 4.4 | 48.6 | 10.7 | 57.9 | 7.1 |
| AD-1230574.1 | 27.9 | 5.0 | 53.3 | 8.8 | 64.2 | 9.6 |
| AD-1230552.1 | 21.8 | 4.8 | 41.0 | 11.0 | 53.9 | 10.6 |
| AD-1230553.1 | 26.2 | 7.3 | 46.1 | 3.5 | 63.4 | 10.5 |
| AD-1230554.1 | 53.6 | 3.4 | 71.6 | 11.1 | 85.8 | 14.1 |
| AD-1230533.1 | 35.8 | 5.8 | 53.7 | 8.2 | 70.6 | 9.7 |
| AD-1230696.1 | 40.0 | 2.8 | 48.2 | 16.9 | 60.1 | 6.6 |
| AD-1230644.1 | 65.8 | 14.7 | 51.9 | 21.4 | 83.9 | 10.3 |
| AD-1230628.1 | 22.8 | 5.8 | 57.2 | 13.4 | 55.1 | 16.5 |
| AD-1230697.1 | 25.1 | 5.0 | 30.9 | 8.0 | 60.9 | 16.4 |
| AD-1230645.1 | 26.6 | 9.1 | 29.5 | 2.3 | 52.4 | 9.5 |
| AD-1230629.1 | 27.9 | 5.7 | 40.3 | 7.7 | 49.5 | 8.7 |
| AD-1230646.1 | 41.8 | 14.3 | 40.5 | 13.3 | 49.7 | 14.7 |
| AD-1230671.1 | 15.9 | 1.0 | 31.1 | 10.5 | 61.6 | 19.8 |
| AD-1230672.1 | 14.3 | 2.0 | 30.6 | 6.2 | 38.7 | 8.7 |
| AD-1230781.1 | 28.8 | 3.8 | 60.4 | 38.0 | 94.0 | 14.7 |
| AD-1230717.1 | 83.6 | 13.2 | 73.4 | 8.4 | 91.1 | 15.0 |
| AD-1230600.1 | 23.3 | 4.9 | 31.6 | 12.4 | 48.3 | 10.5 |
| AD-1230768.1 | 70.8 | 13.3 | 76.8 | 11.7 | 99.9 | 56.4 |
| AD-1230782.1 | 16.9 | 4.2 | 26.6 | 10.5 | 56.6 | 6.9 |
| AD-1230758.1 | 26.7 | 4.9 | 29.3 | 4.6 | 38.4 | 8.4 |
| AD-1230799.1 | 135.0 | 27.3 | 104.5 | 26.6 | 94.7 | 32.7 |
| AD-1230759.1 | 23.2 | 4.0 | 25.2 | 5.4 | 54.2 | 10.5 |
| AD-1230800.1 | 60.6 | 8.3 | 67.5 | 32.3 | 84.5 | 16.5 |
| AD-1230783.1 | 20.0 | 3.6 | 27.9 | 6.4 | 48.4 | 7.7 |
| AD-1230575.1 | 29.7 | 6.5 | 67.3 | 4.7 | 79.0 | 15.3 |
| AD-1230784.1 | 45.4 | 3.6 | 51.9 | 8.3 | 81.3 | 24.3 |
| AD-1230801.1 | 114.4 | 16.0 | 109.3 | 22.2 | 89.1 | 25.4 |
| AD-1230810.1 | 73.0 | 23.5 | 43.6 | 3.1 | 68.5 | 12.6 |
| AD-1230802.1 | 29.2 | 6.4 | 31.1 | 1.2 | 44.6 | 4.0 |
| AD-1230741.1 | 24.2 | 4.6 | 30.9 | 11.9 | 50.5 | 13.7 |
| AD-1230698.1 | 20.0 | 2.9 | 18.8 | 1.9 | 37.2 | 7.0 |
| AD-1230742.1 | 73.0 | 3.9 | 78.8 | 5.7 | 80.2 | 13.9 |
| AD-1230674.1 | 17.8 | 5.4 | 24.4 | 4.7 | 43.2 | 2.2 |
| AD-1230675.1 | 27.3 | 4.6 | 33.2 | 4.3 | 52.3 | 7.0 |
| AD-1230718.1 | 31.3 | 4.6 | 32.2 | 6.2 | 59.0 | 6.1 |
| AD-1230534.1 | 20.4 | 4.8 | 27.8 | 6.8 | 45.5 | 8.9 |
| AD-1230647.1 | 40.2 | 12.8 | 38.3 | 4.5 | 70.3 | 10.8 |
| AD-1230676.1 | 38.0 | 6.3 | 35.1 | 3.4 | 64.5 | 10.4 |
| AD-1230719.1 | 43.6 | 6.0 | 35.3 | 6.1 | 63.6 | 2.5 |
| AD-1230804.1 | 15.4 | 1.6 | 22.7 | 6.1 | 22.0 | 4.2 |
| AD-1230699.1 | 11.0 | 1.5 | 12.0 | 2.2 | 23.1 | 7.2 |
| AD-1230700.1 | 9.0 | 2.9 | 8.5 | 3.4 | 19.5 | 4.3 |
| AD-1230701.1 | 30.4 | 6.5 | 28.4 | 4.6 | 54.0 | 20.5 |
| AD-1230648.1 | 16.2 | 0.5 | 25.9 | 10.4 | 32.9 | 7.9 |
| AD-1230603.1 | 12.5 | 0.5 | 15.8 | 2.4 | 25.2 | 9.8 |
| AD-1230604.1 | 9.9 | 2.6 | 22.2 | 0.6 | 28.6 | 7.9 |
| AD-1230649.1 | 27.7 | 3.3 | 53.5 | 15.3 | 51.8 | 4.4 |
| AD-1230650.1 | 21.0 | 3.6 | 40.5 | 18.2 | 43.7 | 7.5 |
| AD-1230555.1 | 14.5 | 6.0 | 17.3 | 4.2 | 32.4 | 10.6 |
| AD-1230811.1 | 45.8 | 6.6 | 35.1 | 2.6 | 65.3 | 13.0 |
| AD-1230785.1 | 36.3 | 3.7 | 37.5 | 8.2 | 55.4 | 16.3 |
| AD-1230812.1 | 44.4 | 4.4 | 38.0 | 2.3 | 53.7 | 5.2 |
| AD-1230813.1 | 31.0 | 2.1 | 36.8 | 13.1 | 51.7 | 10.9 |
| AD-1230771.1 | 50.0 | 0.8 | 51.4 | 7.6 | 68.8 | 9.8 |
| AD-1230772.1 | 56.2 | 10.3 | 63.5 | 13.8 | 69.3 | 8.1 |
| AD-1230773.1 | 56.9 | 5.9 | 56.0 | 11.9 | 73.6 | 11.9 |
| AD-1230720.1 | 42.1 | 7.8 | 36.1 | 5.6 | 49.4 | 3.5 |
| AD-1230631.1 | 26.8 | 6.7 | 32.3 | 5.7 | 39.1 | 10.3 |
| AD-1230677.1 | 37.9 | 6.6 | 32.3 | 3.9 | 42.7 | 5.9 |
| AD-1230744.1 | 48.7 | 6.8 | 58.5 | 17.2 | 64.4 | 5.7 |
| AD-1230651.1 | 57.5 | 4.3 | 58.6 | 8.5 | 71.2 | 17.0 |
| AD-1230652.1 | 45.1 | 10.1 | 48.8 | 18.3 | 67.3 | 5.8 |
| AD-1230576.1 | 42.7 | 6.7 | 72.2 | 7.7 | 65.7 | 10.3 |
| AD-1230774.1 | 45.5 | 1.6 | 48.0 | 9.4 | 65.4 | 8.2 |
| AD-1230678.1 | 23.5 | 3.0 | 29.1 | 6.2 | 29.1 | 5.0 |
| AD-1230702.1 | 45.2 | 3.1 | 37.3 | 3.2 | 65.4 | 6.3 |
| AD-1230775.1 | 43.9 | 16.6 | 51.8 | 20.5 | 63.1 | 10.0 |
| AD-1230816.1 | 75.2 | 2.8 | 83.1 | 12.7 | 67.3 | 12.7 |
| AD-1230679.1 | 39.8 | 4.0 | 76.1 | 13.0 | 83.0 | 24.4 |
| AD-1230605.1 | 19.6 | 6.1 | 39.5 | 7.5 | 45.5 | 4.7 |
| AD-1230632.1 | 21.0 | 5.3 | 30.3 | 3.7 | 42.3 | 6.9 |
| AD-1230653.1 | 44.6 | 11.0 | 43.8 | 6.8 | 55.8 | 17.0 |
| AD-1230606.1 | 20.4 | 6.0 | 32.7 | 7.0 | 40.4 | 7.8 |
| AD-1230556.1 | 35.7 | 4.3 | 39.7 | 5.5 | 53.4 | 4.8 |
| AD-1230703.1 | 40.8 | 6.1 | 36.6 | 16.1 | 58.4 | 10.0 |
| AD-1230704.1 | 29.5 | 4.9 | 23.9 | 5.8 | 35.8 | 7.3 |
| AD-1230654.1 | 25.0 | 4.4 | 36.9 | 8.5 | 51.5 | 9.1 |
| AD-1230577.1 | 41.3 | 7.2 | 54.8 | 12.7 | 68.2 | 11.1 |
| AD-1230535.1 | 23.4 | 7.8 | 34.2 | 4.6 | 33.8 | 5.5 |
| AD-1230705.1 | 27.1 | 3.5 | 29.7 | 8.2 | 49.1 | 2.7 |
| AD-1230655.1 | 48.7 | 8.0 | 28.5 | 7.6 | 44.4 | 12.6 |
| AD-1230521.1 | 34.8 | 7.8 | 53.0 | 5.0 | 52.1 | 9.9 |
| AD-1230557.1 | 26.1 | 5.2 | 37.4 | 10.2 | 45.5 | 8.7 |
| AD-1230607.1 | 23.8 | 5.0 | 37.3 | 19.4 | 48.3 | 11.6 |
| AD-1230721.1 | 28.8 | 6.6 | 24.5 | 5.9 | 25.2 | 3.1 |
| AD-1230706.1 | 19.4 | 5.4 | 20.0 | 6.0 | 35.9 | 4.9 |
| AD-1230656.1 | 43.4 | 5.6 | 68.7 | 4.7 | 65.9 | 8.2 |
| AD-1230680.1 | 22.4 | 3.4 | 46.2 | 16.3 | 53.3 | 5.5 |
| AD-1230681.1 | 31.2 | 9.1 | 33.9 | 2.8 | 52.5 | 6.1 |
| AD-1230745.1 | 31.5 | 7.9 | 26.8 | 5.1 | 36.0 | 11.5 |
| AD-1230786.1 | 33.8 | 6.2 | 36.9 | 5.1 | 53.0 | 2.8 |
| AD-1230746.1 | 40.2 | 7.4 | 50.9 | 14.3 | 76.9 | 28.7 |

TABLE 4-continued

TMPRSS2 Single Dose Screens in PHH cells

| Duplex ID | 10 nM Avg | SD | 1 nM Avg | SD | 0.1 nM Avg | SD |
|---|---|---|---|---|---|---|
| AD-1230747.1 | 46.6 | 4.5 | 47.2 | 5.2 | 61.8 | 6.0 |
| AD-1230748.1 | 51.4 | 15.5 | 56.6 | 20.1 | 62.8 | 7.0 |
| AD-1230776.1 | 27.4 | 4.4 | 38.1 | 8.2 | 47.9 | 11.9 |
| AD-1230787.1 | 36.8 | 7.2 | 38.9 | 7.2 | 59.5 | 11.5 |
| AD-1230805.1 | 38.6 | 6.5 | 32.4 | 7.0 | 53.0 | 10.1 |
| AD-1230777.1 | 39.0 | 5.1 | 51.6 | 6.1 | 64.6 | 7.2 |
| AD-1230722.1 | 31.7 | 4.0 | 25.7 | 3.9 | 29.2 | 1.4 |
| AD-1230723.1 | 26.5 | 4.6 | 23.7 | 3.6 | 46.1 | 14.9 |
| AD-1230760.1 | 37.5 | 12.2 | 37.4 | 4.9 | 40.7 | 7.4 |
| AD-1230778.1 | 52.6 | 10.0 | 52.0 | 11.6 | 68.0 | 15.8 |
| AD-1230724.1 | 55.8 | 6.6 | 54.9 | 15.1 | 93.2 | 23.2 |
| AD-1230578.1 | 42.7 | 2.8 | 48.6 | 8.8 | 76.7 | 4.8 |
| AD-1230608.1 | 32.6 | 3.0 | 41.1 | 6.6 | 62.2 | 7.5 |
| AD-1230579.1 | 43.8 | 7.1 | 53.7 | 9.4 | 73.7 | 5.3 |
| AD-1230682.1 | 35.2 | 5.4 | 47.2 | 12.6 | 67.5 | 11.6 |
| AD-1230779.1 | 63.7 | 5.3 | 72.5 | 8.0 | 98.2 | 10.3 |
| AD-1230707.1 | 37.7 | 0.7 | 38.9 | 3.7 | 48.8 | 3.0 |
| AD-1230761.1 | 49.2 | 21.2 | 59.1 | 15.5 | 83.4 | 25.8 |
| AD-1230817.1 | 100.9 | 11.0 | 73.1 | 9.0 | 79.5 | 9.0 |
| AD-1230806.1 | 51.8 | 9.8 | 59.0 | 8.5 | 93.2 | 29.6 |
| AD-1230807.1 | 62.8 | 7.3 | 56.2 | 21.6 | 67.2 | 25.0 |
| AD-1230749.1 | 65.6 | 2.7 | 57.9 | 4.4 | 54.5 | 10.5 |
| AD-1230708.1 | 23.0 | 2.8 | 24.2 | 1.2 | 43.4 | 15.1 |
| AD-1230709.1 | 50.9 | 3.5 | 45.8 | 15.2 | 89.5 | 17.7 |
| AD-1230750.1 | 34.7 | 10.8 | 31.9 | 8.4 | 44.0 | 7.6 |
| AD-1230788.1 | 36.5 | 9.0 | 39.2 | 4.0 | 47.7 | 4.7 |
| AD-1230683.1 | 27.3 | 3.2 | 34.7 | 5.4 | 48.0 | 11.9 |
| AD-1230580.1 | 31.8 | 2.7 | 38.8 | 10.2 | 47.6 | 13.2 |
| AD-1230581.1 | 38.0 | 3.9 | 59.3 | 11.8 | 66.2 | 10.4 |
| AD-1230582.1 | 26.9 | 3.9 | 48.9 | 9.2 | 51.2 | 10.1 |
| AD-1230609.1 | 23.7 | 7.4 | 21.7 | 6.0 | 39.1 | 6.0 |
| AD-1230633.1 | 21.8 | 6.2 | 29.3 | 6.3 | 48.2 | 20.0 |
| AD-1230725.1 | 47.1 | 8.2 | 42.0 | 5.4 | 49.5 | 6.9 |
| AD-1230726.1 | 41.8 | 8.2 | 40.5 | 7.0 | 50.5 | 6.7 |
| AD-1230727.1 | 43.9 | 8.9 | 37.8 | 7.0 | 52.1 | 6.0 |
| AD-1230710.1 | 33.5 | 4.3 | 33.7 | 4.6 | 57.6 | 12.1 |
| AD-1230610.1 | 19.7 | 3.8 | 26.6 | 3.7 | 40.7 | 9.1 |
| AD-1230657.1 | 48.2 | 8.6 | 67.5 | 6.1 | 76.4 | 5.1 |
| AD-1230658.1 | 40.1 | 13.3 | 52.5 | 7.6 | 59.7 | 9.6 |
| AD-1230684.1 | 28.7 | 9.5 | 33.3 | 6.9 | 41.4 | 6.9 |
| AD-1230611.1 | 37.8 | 7.2 | 69.9 | 10.0 | 54.5 | 7.7 |
| AD-1230558.1 | 27.3 | 6.5 | 29.5 | 10.8 | 43.3 | 2.8 |
| AD-1230583.1 | 39.0 | 6.7 | 63.0 | 7.7 | 90.0 | 15.8 |
| AD-1230634.1 | 41.9 | 5.9 | 81.4 | 21.8 | 74.3 | 21.4 |
| AD-1230659.1 | 32.9 | 5.8 | 28.0 | 7.8 | 51.4 | 5.7 |
| AD-1230660.1 | 38.8 | 8.7 | 42.7 | 10.6 | 55.1 | 11.8 |
| AD-1230728.1 | 51.8 | 6.3 | 44.3 | 3.9 | 52.3 | 6.2 |
| AD-1230661.1 | 49.5 | 7.4 | 52.0 | 9.9 | 66.8 | 12.1 |
| AD-1230662.1 | 48.2 | 6.3 | 45.5 | 7.6 | 61.1 | 12.1 |
| AD-1230751.1 | 43.5 | 19.3 | 47.1 | 15.8 | 72.7 | 10.9 |
| AD-1230818.1 | 72.1 | 12.7 | 67.1 | 3.8 | 67.1 | 7.9 |
| AD-1230789.1 | 44.9 | 10.6 | 63.0 | 5.9 | 59.1 | 14.8 |
| AD-1230790.1 | 40.1 | 7.5 | 43.9 | 6.2 | 56.0 | 11.3 |
| AD-1230729.1 | 50.0 | 5.3 | 37.5 | 7.7 | 54.5 | 5.2 |
| AD-1230685.1 | 37.7 | 9.5 | 33.0 | 3.9 | 59.2 | 5.6 |
| AD-1230752.1 | 50.1 | 13.3 | 54.0 | 16.9 | 57.7 | 24.6 |
| AD-1230819.1 | 64.0 | 15.5 | 50.1 | 5.2 | 72.7 | 14.3 |
| AD-1230808.1 | 43.9 | 2.5 | 58.1 | 15.7 | 54.2 | 10.5 |
| AD-1230820.1 | 48.9 | 10.8 | 45.4 | 12.6 | 54.9 | 7.9 |
| AD-1230791.1 | 99.4 | 16.3 | 75.7 | 21.7 | 89.2 | 19.1 |
| AD-1230730.1 | 36.9 | 7.3 | 33.2 | 12.0 | 48.4 | 9.2 |
| AD-1230536.1 | 31.2 | 7.1 | 37.7 | 10.5 | 53.6 | 14.2 |
| AD-1230612.1 | 34.5 | 10.3 | 43.8 | 3.6 | 47.8 | 14.6 |
| AD-1230560.1 | 51.5 | 15.0 | 59.7 | 9.7 | 67.0 | 12.2 |
| AD-1230613.1 | 33.1 | 9.9 | 38.3 | 9.5 | 41.9 | 5.8 |
| AD-1230537.1 | 28.3 | 2.5 | 48.1 | 2.8 | 52.3 | 3.1 |
| AD-1230731.1 | 83.9 | 55.9 | 47.1 | 8.9 | 84.8 | 21.2 |
| AD-1230614.1 | 29.6 | 9.0 | 33.9 | 6.1 | 36.4 | 12.4 |
| AD-1230524.1 | 15.0 | 3.9 | 29.9 | 6.4 | 36.6 | 3.8 |
| AD-1230584.1 | 28.2 | 4.4 | 49.5 | 10.9 | 52.7 | 12.7 |
| AD-1230562.1 | 31.3 | 4.5 | 57.1 | 13.3 | 55.9 | 18.1 |
| AD-1230538.1 | 31.6 | 11.5 | 52.2 | 7.5 | 52.6 | 4.6 |
| AD-1230539.1 | 27.1 | 1.1 | 40.6 | 2.6 | 43.7 | 10.6 |
| AD-1230563.1 | 34.3 | 7.9 | 43.4 | 14.7 | 54.8 | 4.6 |
| AD-1230522.1 | 24.0 | 7.0 | 40.4 | 7.3 | 38.9 | 5.6 |
| AD-1230523.1 | 24.5 | 4.8 | 33.2 | 13.4 | 35.5 | 8.2 |
| AD-1230585.1 | 35.9 | 3.9 | 41.6 | 2.9 | 66.7 | 5.4 |
| AD-1230586.1 | 31.1 | 4.0 | 42.0 | 3.8 | 51.5 | 10.0 |
| AD-1230540.1 | 28.6 | 2.9 | 38.7 | 12.1 | 48.1 | 1.0 |
| AD-1230615.1 | 23.5 | 5.0 | 35.5 | 13.1 | 31.7 | 11.2 |
| AD-1230587.1 | 26.9 | 6.3 | 25.6 | 5.3 | 42.0 | 8.7 |
| AD-1230616.1 | 27.5 | 3.8 | 33.8 | 9.7 | 28.7 | 7.5 |
| AD-1230686.1 | 18.4 | 1.5 | 17.4 | 6.5 | 35.5 | 10.0 |
| AD-1230635.1 | 42.1 | 10.1 | 64.4 | 12.0 | 74.0 | 14.7 |
| AD-1230732.1 | 40.1 | 6.9 | 40.7 | 3.6 | 59.4 | 7.7 |
| AD-1230733.1 | 45.4 | 4.6 | 42.2 | 7.2 | 52.1 | 5.6 |

Example 3

In Vivo Screening of dsRNA Duplexes in Mice siRNA molecules targeting the TMPRSS2 gene, identified from the above in vitro studies, are evaluated in vivo.

Mice previously infected with a coronavirus, e.g., severe acute respiratory syndrome-2 (SARS-2)-CoV-2, are administered, via pulmonary or subcutaneous delivery, a dsRNA molecule at a dose of 0.1 mg/kg, 1 mg/kg or 10 mg/kg. Uptake of dsRNA in bronchioles and alveoli and expression level of target gene in whole lung of treated mice are measured. Expression levels of coronavirus target genes are further evaluated by in situ hybridization in mice bronchus and bronchiole.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

INFORMAL SEQUENCE LISTING

```
<210>   1
<211>   3450
<212>   DNA
<213>   Homo sapiens
<400>   1
gagtaggcgc gagctaagca ggaggcggag gcggaggcgg agggcgaggg gcggggagcg     60
ccgcctggag cgcggcaggt catattgaac attccagata cctatcatta ctcgatgctg    120
ttgataacag caagatggct ttgaactcag ggtcaccacc agctattgga ccttactatg    180
aaaaccatgg ataccaaccg gaaaacccct atcccgcaca gcccactgtg gtccccactg    240
tctacgaggt gcatccggct cagtactacc cgtcccccgt gccccagtac gccccgaggg    300
tcctgacgca ggcttccaac cccgtcgtct gcacgcagcc caaatcccca tccgggacag    360
```

-continued

INFORMAL SEQUENCE LISTING

```
tgtgcacctc aaagactaag aaagcactgt gcatcacctt gaccctgggg accttcctcg    420
tgggagctgc gctggccgct ggcctactct ggaagttcat gggcagcaag tgctccaact    480
ctgggataga gtgcgactcc tcaggtacct gcatcaaccc ctctaactgg tgtgatggcg    540
tgtcacactg ccccggcggg gaggacgaga atcggtgtgt tcgcctctac ggaccaaact    600
tcatccttca ggtgtactca tctcagagga agtcctggca ccctgtgtgc caagacgact    660
ggaacgagaa ctacgggcgg gcggcctgca gggacatggg ctataagaat aatttttact    720
ctagccaagg aatagtggat gacagcggat ccaccagctt tatgaaactg aacacaagtg    780
ccggcaatgt cgatatctat aaaaaactgt accacagtga tgcctgttct tcaaaagcag    840
tggtttcttt acgctgtata gcctgcgggg tcaacttgaa ctcaagccgc cagagcagga    900
ttgtgggcgg cgagagcgcg ctcccggggg cctggccctg gcaggtcagc ctgcacgtcc    960
agaacgtcca cgtgtgcgga ggctccatca tcaccccga gtggatcgtg acagccgccc   1020
actgcgtgga aaaacctctt aacaatccat ggcattggac ggcatttgcg gggatttga   1080
gacaatcttt catgttctat ggagccggat accaagtaga aaaagtgatt tctcatccaa   1140
attatgactc caagaccaag aacaatgaca ttgcgctgat gaagctgcag aagcctctga   1200
cttctcaacga cctagtgaaa ccagtgtgtc tgcccaaccc aggcatgatg ctgcagccag   1260
aacagctctg ctggatttcc gggtgggggg ccaccgagga gaaagggaag acctcagaag   1320
tgctgaacgc tgccaaggtg cttctcattg agacacagag atgcaacagc agatatgtct   1380
atgacaacct gatcacacca gccatgatct gtgccggctt cctgcagggg aacgtcgatt   1440
cttgccaggg tgacagtgga gggcctctgg tcacttcgaa gaacaatatc tggtggctga   1500
tagggatac aagctgggt tctggctgtg ccaaagctta cagaccagga gtgtacggga   1560
atgtgatggt attcacggac tggatttatc gacaaatgag ggcagacggc taatccacat   1620
ggtcttcgtc cttgacgtcg ttttacaaga aacaatggg gctggttttg cttcccccgtg   1680
catgatttac tcttagagat gattcagagg tcacttcatt tttattaaac agtgaacttg   1740
tctggctttg gcactctctg ccattctgtg caggctgcag tggctccct gcccagcctg   1800
ctctccctaa cccctggtcc gcaagggtg atggccggct ggtgtggc actggcggtc    1860
aagtgtggag gagaggggtg gaggctgccc cattgagatc ttcctgctga gtcctttcca   1920
ggggccaatt ttgatgagc atggagctgt cacctctcag ctgctggatg acttgagatg   1980
aaaaaggaga gacatggaaa gggagcagc caggtgcac ctgcagcggc tgccctctgg    2040
ggccacttgg tagtgtcccc agcctacctc tccacaaggg gattttgctg atgggtctt   2100
agagccttag cagccctgga tggtggcag aaataaaggg accagccctt catgggtggt   2160
gacgtggtag tcacttgtaa ggggaacaga aacattttg ttcttatggg gtgagaatat   2220
agacagtgcc cttggtgcga gggaagcaat tgaaaaggaa cttgccctga gcactcctgg   2280
tgcaggtctc cacctgcaca ttgggtgggg ctcctggag ggagactcag ccttcctcct   2340
catcctccct gaccctgctc ctagcaccct ggagagtgca catgcccctt ggtcctggca   2400
gggcgccaag tctggcacca tgttggcctc ttcaggcctg ctagtcactg gaaattgagg   2460
tccatgggg aaatcaagga tgctcagttt aaggtacact gtttccatgt tatgttcta    2520
cacattgcta cctcagtgct cctggaaact tagcttttga tgtctccaag tagtccacct   2580
tcatttaact ctttgaaact gtatcatctt tgccaagtaa gagtggtggc ctatttcagc   2640
tgctttgaca aaatgactgg ctcctgactt aacgttctat aaatgaatgt gctgaagcaa   2700
agtgccatg gtggcggcga agaagagaaa gatgtgtttt gttttggact ctctgtggtc   2760
ccttccaatg ctgtgggttt ccaaccaggg gaagggtccc ttttgcattg ccaagtgcca   2820
taaccatgag cactactcta ccatggttct gcctcctggc caagcaggct ggtttgcaag   2880
aatgaaatga atgattctac agctaggact taaccttgaa atggaaagtc atgcaatccc   2940
atttgcagga tctgtctgtg cacatgcctc tgtagagagc agcattccca gggaccttgg   3000
aaacagttgg cactgtaagg tgcttgctcc ccaagacaca cctaaaagg tgttgtaatg   3060
gtgaaaacgt cttccttctt tattgcccct tcttatttat gtgaacaact gtttgtcttt   3120
ttttgtatct ttttttaaact gtaaagttca attgtgaaaa tgaatatcat gcaaataaat   3180
tatgcaattt ttttttcaaa gtaactactg catcttgaa gttctgcctg gtgagtagga   3240
ccagcctcca tttccttata aggggtgat gttgaggctg ctggtcagag gaccaaaggt   3300
gaggcaaggc cagacttggt gctcctgtgg ttggtgccct cagttcctgc agcctgtcct   3360
gttggagagg tccctcaaat gactccttct tattattcta ttagtctgtt tccatgctcc   3420
taataaagac atacccaaga ctgcaattta                                     3450
```

<210> 2
<211> 3250
<212> DNA
<213> Homo sapiens
<400> 2

```
accagggtcc cggctcgggg tccgggctgg ggaggggaac ctgggcgcct gggacccgcc     60
gatgccccct gccccgcccg gaggtgaaag cgggtgtgag gagcgcggcg cggcaggtca    120
tattgaacat tccagatacc tatcattact cgatgctgtt gataacagca agatggcttt    180
gaactcaggg tcaccaccag ctattggacc ttactatgaa aaccatggat accaaccgga    240
aaacccctat cccgcacagc ccactgtggt ccccactgtc tacgaggtgc atccggctca    300
gtactacccg tcccccgtgc cccagtacgc cccgagggtc ctgacgcagg cttccaaccc    360
cgtcgtctgc acgcagccca aatcccatc cgggacagtg tgcacctcaa agactaagaa    420
agcactgtgc atcaccttga ccctggggac cttcctcgtg gagctgcgc tggccgctgg    480
cctactctgg aagttcatgg gcagcaagtg ctccaactct gggatagagt gcgactcct    540
aggtacctgc atcaacccct ctaactggtg tgatggcgtg tcacactgcc ccggcgggga    600
ggacgagaat cggtgtgttc gcctctacgg accaaacttc atccttcagg tgtactcatc    660
tcagaggaag tcctggcacc ctgtgtgcca agacgactgg aacgagaact acgggcgggc    720
ggcctgcagg gacatgggct ataagaataa ttttactct agccaaggaa tagtggatga    780
cagcggatcc accagcttta tgaaactgaa cacaagtgc cagcttta tgaaactgaa cacaagtcg atatctataa    840
aaaactgtac cacagtgatg cctgttcttc aaaagcagtg gtttctttac gctgtatagc    900
ctgcggggtc aacttgaact caagccgcca gagcaggat tgtgggcgcg agagcgcgct    960
cccgggggcc tggccctgc aggtcagcct gcacgtccag aacgtccacg tgtgcggagg   1020
ctccatcatc acccccgagt ggatcgtgac agccgcccac tgcgtggaaa aacctcttaa   1080
caatccatgg cattggacgg catttgcggg gattttgaga caatctttca tgttctatgg   1140
```

-continued

| INFORMAL SEQUENCE LISTING | | | | | |
|---|---|---|---|---|---|
| agccggatac | caagtagaaa | aagtgatttc | tcatccaaat | tatgactcca | agaccaagaa | 1200 |
| caatgacatt | gcgctgatga | agctgcagaa | gcctctgact | ttcaacgacc | tagtgaaacc | 1260 |
| agtgtgtctg | cccaacccag | gcatgatgct | gcagccagaa | cagctctgct | ggatttccgg | 1320 |
| gtgggggggcc | accgaggaga | aagggaagac | ctcagaagtg | ctgaacgctg | ccaaggtgct | 1380 |
| tctcattgag | acacagagat | gcaacagcag | atatgtctat | gacaacctga | tcacaccagc | 1440 |
| catgatctgt | gccggcttcc | tgcagggaaa | cgtcgattct | tgccagggtg | acagtggagg | 1500 |
| gcctctggtc | acttcgaaga | acaatatctg | gtggctgata | ggggatacaa | gctggggttc | 1560 |
| tggctgtgcc | aaagcttaca | gaccaggagt | gtacgggaat | gtgatggtat | tcacggactg | 1620 |
| gatttatcga | caaatgaggg | cagacggcta | atccacatgg | tcttcgtcct | tgacgtcgtt | 1680 |
| ttacaagaaa | acaatggggc | tggttttgct | tccccgtgca | tgatttactc | ttagagatga | 1740 |
| ttcagaggtc | acttcatttt | tattaaacag | tgaacttgtc | tggctttggc | actctctgcc | 1800 |
| attctgtgca | ggctgcagtg | gctccccctgc | ccagcctgct | ctccctaacc | ccttgtccgc | 1860 |
| aagggggtgat | ggccggctgg | ttgtgggcac | tggcggtcaa | gtgtggagga | gaggggtgga | 1920 |
| ggctgcccca | ttgagatctt | cctgctgagt | cctttccagg | ggccaatttt | ggatgagcat | 1980 |
| ggagctgtca | cctctcagct | gctggatgac | ttgagatgaa | aaaggagaga | catggaaagg | 2040 |
| gagacagcca | ggtggcacct | gcagcggctg | ccctctgggg | ccacttggta | gtgtccccag | 2100 |
| cctacctctc | cacaagggga | ttttgctgat | gggttcttag | agccttagca | gccctggatg | 2160 |
| gtggccagaa | ataaagggac | cagcccttca | tgggtggtga | cgtggtagtc | acttgtaagg | 2220 |
| ggaacagaaa | cattttttgtt | cttatggggt | gagaatatag | acagtgccct | tggtgcgagg | 2280 |
| gaagcaattg | aaaaggaact | tgccctgagc | actcctggta | ggatgctcca | cctgcacatt | 2340 |
| gggtggggct | cctgggaggg | agactcagcc | ttcctcctca | tcctccctga | ccctgctcct | 2400 |
| agcaccctgg | agagtgcaca | tgccccttgg | tcctggcagg | gcgccaagtc | tggcaccatg | 2460 |
| ttggcctctt | caggcctgct | agtcactgga | aattgaggtc | catgggggaa | atcaaggatg | 2520 |
| ctcagtttaa | ggtacactgt | ttccatgtta | tgtttctaca | cattgctacc | tcagtgctcc | 2580 |
| tggaaactta | gcttttgatg | tctccaagta | gtccaccttc | atttaactct | ttgaaactgt | 2640 |
| atcatctttg | ccaagtaaga | gtggtggcct | atttcagctg | ctttgacaaa | atgactggct | 2700 |
| cctgacttaa | cgttctataa | atgaatgtgc | tgaagcaaag | tgcccatggt | ggcggcgaag | 2760 |
| aagagaaaga | tgtgttttgt | tttggactct | ctgtggtccc | ttccaatgct | tgggggtttcc | 2820 |
| aaccagggga | agggtcccctt | ttgcattgcc | aagtgccata | accatgagca | ctactctacc | 2880 |
| atggttctgc | ctcctggcca | agcaggctgg | tttgcaagaa | tgaaatgaat | gattctacag | 2940 |
| ctaggactta | accttgaaat | ggaaagtcat | gcaatcccat | ttgcaggatc | tgtctgtgca | 3000 |
| catgcctctg | tagagagcag | cattcccagg | gaccttggaa | agcattggca | ctgtaaggtg | 3060 |
| cttgctcccc | aagacacatc | ctaaaaggtg | ttgtaatggt | gaaaacgtct | tccttcttta | 3120 |
| ttgccccttc | ttatttatgt | gaacaactgt | ttgtctttttt | ttgtatctttt | tttaaactgt | 3180 |
| aaagttcaat | tgtgaaaatg | aatatcatgc | aaataaatta | tgcaattttt | ttttcaaagt | 3240 |
| aaaaaaaaaa | | | | | | 3250 |

<210> 3
<211> 3175
<212> DNA
<213> Mus musculus
<400> 3

| gcctttcctg | gccgttccct | ccttctggcc | gaggtgcctg | cgtttagggg | tgtcaccctg | 60 |
| gctcccggga | cgccgcctcc | ggagatttaa | gcgagaactg | gagtaggtcg | tgtacttgga | 120 |
| gcggacgagg | aagccaagag | ctcggacaga | ggcggagagg | ggcgggaagc | gcaacaggtc | 180 |
| acctggagga | agcccccatac | tgacctcctc | atgctgctga | cacaggcagg | atggcattga | 240 |
| actcagggtc | acctccagga | atcggacctt | gctatgagaa | ccacgggtat | cagtctgagc | 300 |
| acatctgtcc | tccgagacca | ccagtggctc | ccaatggcta | caacttgtat | ccagcccagt | 360 |
| actacccatc | tccagtgcct | cagtatgctc | cgaggattac | aacgcaagcc | tcaacatctg | 420 |
| tcatccacac | acatcccaag | tcctcaggag | cactgtgcac | ctcaaagtct | aagaaatcgc | 480 |
| tgtgtttagc | cctcgccctg | ggcactgtcc | tcacgggagc | tgctgtggct | gctgtcttgc | 540 |
| tttggaggtt | ctgggacagc | aactgttcta | cgtctgagat | ggagtgtggg | tcttcaggca | 600 |
| catgcatcag | ctcttctctc | tggtgtgacg | gggtagcaca | ttgtcccaac | ggagaagatg | 660 |
| agaaccgttg | tgttcgtctc | tacgacaaa | gcttcatcct | ccaggtttac | tcatctcaga | 720 |
| ggaaagcctg | gtatcccgtg | tgccaggatg | attggagtga | gagctacggg | agagcagcat | 780 |
| gtaaagacat | gggatacaag | aacaattttt | attctagcca | agggatacca | gaccagagcg | 840 |
| gggcaacgag | ctttatgaag | ctgaatgtga | gctcaggcaa | cgttgacctc | tataaaaaac | 900 |
| tctaccacag | tgactcatgt | tcatcccgca | tggtggtttc | tttgcgctgt | atagaatgcg | 960 |
| gggttcgctc | agtgaaacgc | cagagcagga | ttgtgggtgg | attgaatgcc | tcaccaggag | 1020 |
| actggccctg | gcaggtcagc | ctgcacgtcc | aaggcgtcca | cgtctgcgga | ggctccatca | 1080 |
| tcaccccga | gtggattgtg | acggccgccc | actgtgtgga | agaacccctc | agcagcccga | 1140 |
| ggtactggac | ggcatttgcg | ggaattctga | gacagtcctt | catgttctat | ggaagtagac | 1200 |
| accaggtaga | aaaagtaatt | tcccatccaa | attacgactc | taagaccaag | aataacgaca | 1260 |
| ttgctctcat | gaagctgcag | acaccttggg | cttttaatga | tctagtgaag | ccagtgtgtc | 1320 |
| tgccgaaccc | aggcatgatg | ctagacctag | accaggaatg | ctggatttcg | gggtgggggg | 1380 |
| ccacctatga | gaaagggaag | acctcggacg | tgttgaatgc | tgccatggta | cccttgatcg | 1440 |
| agccctccaa | atgtaatagt | aaatacatat | acaacaacct | aatcacacca | gccatgatct | 1500 |
| gtgccggctt | cctccagggg | tctgtcgact | cttgccaggg | agacagtgga | gggccgctgg | 1560 |
| ttactttgaa | gaatgggatc | tggtggctga | ttggggacac | gagctgggc | tcgggctgtg | 1620 |
| ccaaggcact | cagacctgga | gtatacggga | acgtgacggt | atttacagat | tggatctacc | 1680 |
| agcaaatgag | ggcgaacagc | taatccacgt | ggctttgtcc | cagacttcct | ttgtcttcaa | 1740 |
| caaccttctg | caagaaaacc | aagggcctga | atttttaactt | cctgtgcaca | atgtacctttt | 1800 |
| tgagatgatt | cgaagggcct | ttcactttta | ttaaacagtg | acttgtttga | ctgtgctccc | 1860 |
| tggtcctgtg | agggcttcag | tgccccaccc | ctgggccact | tctgcagctc | caccagaat | 1920 |
| ggatgaccag | attctgttgg | gtttgggcac | atagggccaa | aggcagagga | gggtggcact | 1980 |
| ctcatgttgg | aacttctttt | gggctcatgc | tcaggccttt | tttggatcac | taaggactat | 2040 |
| gacctctgag | taacctgatg | acctgagaaa | gagtaaggag | gccaggcagg | gccttgggcc | 2100 |

-continued

INFORMAL SEQUENCE LISTING

| | | | | |
|---|---|---|---|---|
| caggaacagg | taccttgaga | gtgagagcta | cccattgcct | gtggcctaaa tctgctgtgc 2160 |
| aggttgggct | ggtcatactg | tcatgatttc | attaacagcc | tgggtgaaca tggctgggag 2220 |
| taaagggctt | gctctcctgc | atgttgacat | gacggccctt | tccaagggtg atggaggctt 2280 |
| tcccaagcta | agggcctagg | cagatctctc | agagcaagaa | gctaatgccg gcatgtccct 2340 |
| tgggtgagct | ctacatggtg | ttattcagtc | tggttcttgg | ctccccacta ctgtttctct 2400 |
| cagcctctca | gagcctgaaa | cttacctctt | agctttggct | acaggcatgg cctagtacct 2460 |
| gatggagcct | gtatagctca | gctaatcaaa | tggaggctca | ggtccatcag aatcagggac 2520 |
| ttgtgatttc | agtcaccttg | cttctgggtt | gtgtttcttc | tcttactacc tcactgcacc 2580 |
| tggacactag | agtggatgaa | tgtctggagt | tcacctgcat | ttggactgtg tgattgtgcc 2640 |
| tcagacacta | gacctcttcc | agatggttag | gttgttctgt | agactggcaa tgagattaga 2700 |
| agttcctagc | ttcagataaa | gatgaaagag | aggagatcat | tgtcttctgt cttcttctgg 2760 |
| ccctgggttt | ataccaggaa | agccatgcca | gaattaccaa | atatgaagta tgaatgtctt 2820 |
| acccacggtg | aggctctgcc | tccttctctc | tgcctggttc | ttcagaaggc agtgaatggg 2880 |
| tcataactgg | gactccatct | ttgctgggga | aagtctccca | cctagggaat ggttaccact 2940 |
| ccatgtaaag | aaaactccct | catgcgtcct | ctgggacctt | cttagatgct gtaaggtacc 3000 |
| tacatacaga | ctaaatgtgc | aagcaccttg | aagtgtgaga | acctgtcccc tccttagctc 3060 |
| tccttgtctt | tgctgttggt | tggttatttc | ctgctttgtg | tctgttctga gctgtgagat 3120 |
| tccactgtga | aatatatgaa | taaagtatat | aattctttta | aaaaaaaaaa aaaaa 3175 |

<210> 4
<211> 3135
<212> DNA
<213> Rattus norvegicus
<400> 4

| | | | | |
|---|---|---|---|---|
| ctggagtagg | tcgtgtactt | ggagtggaca | aggaaaccga | gagccccggc ggaggcggag | 60 |
| aggggcgggg | agcacagcag | gtcacctgga | ggaagccaca | tactgacctc ctcatgctgc | 120 |
| tgacacaggg | aggatggcat | tgaactcagg | gtcacctcca | ggaattggac cttactatga | 180 |
| gaaccacggg | tatcagtctg | agcacgtcta | ttccccgagg | ccacctgtgt ctcccagtgg | 240 |
| ctacaacttg | tatccagccc | agagctgccc | atctccagtg | ccccagtatg ctccgagagt | 300 |
| cacaacttcaa | gcctcaacac | ctgccatcca | catacagccc | cgatcctcag gaacactgtg | 360 |
| cacctcaaaa | tctaagaaat | ccatgcttgt | cgccctggcc | ctgggcactg tcctcgccgg | 420 |
| tgctgctgtg | gctgctggct | tgctttggaa | gttctgggac | agcaagtgct cttcatcaga | 480 |
| gatggagtgt | gggtcttcag | ggacatgtat | cagctcctcc | ctctgtgtg acggagtgtc | 540 |
| acagtgtccc | aacggggaag | acgagaaccg | gtgtgttcgc | ctctatggaa caagcttcac | 600 |
| cctccaggtt | tactcatctc | agaggaaagc | ctggtatccc | gtctgccagg atgattggaa | 660 |
| tgagagctac | gggagagcag | catgtaaaga | catgggatac | aagaacagct tttattctag | 720 |
| ccaagggata | ccagaccaga | gcggggcaac | gagctttatg | aagctgaatg tgagcgcagg | 780 |
| caacgtcgac | ctctataaaa | aactctacca | cagtgactcg | tgctcatccc gcatggtggt | 840 |
| ttctttgcgc | tgtatagaat | gcggggttcg | ctcagtaaga | cgtcagagca ggattgtggg | 900 |
| tgggtcgacc | gcctcaccag | gagactggcc | ctggcaggtc | agcctgcacg tccaaggtat | 960 |
| ccatgtctgc | ggaggctcca | tcatcacccc | cgagtggatt | gtgacagccg cccactgtgt | 1020 |
| ggaagaaccc | ctcagcagcc | ctaggtactg | gacggcattt | gcgggaattt tgaaacagtc | 1080 |
| tctcatgttc | tatggaagta | gacaccaggt | agaaaaagtg | atttcccatc caaattacga | 1140 |
| ctctaagacc | aagaataatg | acattgctct | catgaagctg | cagacaccct tggcttttaa | 1200 |
| tgatgtagtg | aagccagtgt | gtctgccgaa | cccaggcatg | atgctggacc tagcccagga | 1260 |
| gtgctggatt | tcagggtggg | gggccaccta | tgagaaaggg | aagacctcag atgtgctgaa | 1320 |
| tgctgccatg | gtaccttga | tcgagccctc | caaatgtaat | agcaaataca tatacaacaa | 1380 |
| cttaatcaca | ccagccatga | tctgcgccgg | gttcctccag | ggctctgtcg actcttgtca | 1440 |
| gggagacagt | ggagggcccc | tggttacttt | gaagaatgaa | atctggtggc tgattgggga | 1500 |
| cacgagctgg | ggctcgggct | gtgccaaggc | atacagacct | ggagtatacg ggaatgtgac | 1560 |
| agtatttaca | gattggatct | accagcaaat | gagggcgaac | agctaatcca cgtggctttg | 1620 |
| tccccgactt | cctttgtctt | caacaacctt | ctgcaagaaa | accaagggc ggattttcaa | 1680 |
| cttcctgtgc | acaatgtacc | ttttgagatg | attcaaaggg | cctttcactt ttattaaaca | 1740 |
| gtgacttatc | tgactgtgct | ccctggtcct | gtgagggctt | cagtgcccca ccctccaggc | 1800 |
| tacttcagca | gctcctacca | gaaaggatga | ccagatcctg | ttgggtttgg gcacataggg | 1860 |
| ccaaatacag | aagaaggtgg | cactctcatg | ttgagacttc | ttttggctt atgctcaggc | 1920 |
| ctcttttgga | tgagtaagga | ctatgacctc | tgagtagtct | gatgacctga gaagagtagg | 1980 |
| gaagccaggc | agggccttgg | gccaaggtac | aggtacagag | agagaaagag agagagagag | 2040 |
| agagagagag | agagagagag | agagagagag | agagagagag | agagagaaca ctacccattg | 2100 |
| cctgtgcct | agctctgctg | tgtagttttg | ggctggtcat | actataatga cttcatgaac | 2160 |
| aacagcccag | gagtaaagga | cttattctcc | tgcatgttga | catgacagtc atttccaagg | 2220 |
| ttgatggaac | ctttgccagg | ctgagggcct | aggcagggcc | ttcagagcaa gaaactaatg | 2280 |
| tctgcatgtc | ccttgggtga | gctctatatg | gtatcattca | gtctggttct tggctcccca | 2340 |
| ccgctatttc | tgtcagcctt | tcacagcctg | aaacttacct | ctttggtttg gctccaggta | 2400 |
| aggcctggta | cttgatggag | cctgtatagc | tcagctagtc | atctagaggc tgaggtccat | 2460 |
| tagaatcagg | gacttgtgaa | tccagtcacc | ttgctctgg | gttgtgttta ttcccttact | 2520 |
| acctcactgc | acctgcacac | tagtctggat | gaatgtctgt agttcacctg | catttggact | 2580 |
| gtgtgcttgt | gcctcagata | ttagacctct | tccagatggt | taggttgttc tgtagactga | 2640 |
| cgatgggatt | agtagtccca | agctttggac | aaagatgaaa | aagaggagct cgttgtcttc | 2700 |
| tatccttttc | tggccctggg | tttataccag | gaaagccatg | ccacaatcac caaatatgaa | 2760 |
| gtatgaatgt | cttacctatg | gtgaggctct | gcctcctcct | ctgtgcctgg ctcttcagaa | 2820 |
| ggcagtgaat | gggtcacagc | tgggactccg | tctttgctgg | ggaggctctc ccaccaagga | 2880 |
| aatagttgcc | actccatgta | aagagttccc | tcatgcttcc | tctgggaaca acactctagg | 2940 |
| gaccttctta | tgatgccataa | ggtacctact | tacaagacta | aatgtacaag caccttgaag | 3000 |
| tgtgagaaca | tgttccctcc | ttagctctcc | ctgtctttgc | tgttggttgg ttatttcctg | 3060 |
| ttttgtgtct | gttctgagct | gtgagattcc | actgtgaaat | gtatgaataa agtatgtaat | 3120 |
| tctgtccatt | gttca | | | 3135 |

INFORMAL SEQUENCE LISTING

<210> 5
<211> 3609
<212> DNA
<213> Macaca fascicularis
<400> 5

```
gtgagtcacc acgcccgacc cagctggaga acgttattgg cagcatcact ctggtcttcc      60
atttcaaagt ccatggtagc tgatttgggc acgctgaata ttttgttta tcatgttctg      120
attgctggaa gagataggat tatcctgcca ctgcctctgg gtcccgtggc ttttatttga      180
caattaatgg tggtggctcc cggtgttcct tccttccctg gcttccttgt tagggatcgt      240
gaatgaatag caagtgtggg ttttgagcac tgattcttca ttcctttcag agggcttctg      300
agctgggaga gccgccaatg ggatcgaatt ttcacttcct gaaacttcaa ccaaacctat      360
aactggggag ataggagagc tgagaaacca gaggcgtgag aatgtgtttg gttaggcagg      420
actctttgaa agcaatctta ggacggtact gagttctctc ctgcttatga gacaagaatg      480
cgggatttat tgtgttgatg tcaggcctga ggatcctctc tcttcacaaa gcagacatag      540
gtcatactga acattccaga tacctatcat tactcgatgc tgttgataaa agcaagatgg      600
ctttgaactc agggtcaccg ccaggtgttg gaccttacta cgaaaaccat ggataccaac      660
cggaaaaccc ctatcctgca cagcccaccg tggcccccaa tgtctacgag gtgcatccgg      720
ctcagtacta cccgtccccc gtacccagt acaccccgag ggtcctgacg catgcttcca      780
accccgccgt ctgcaggcag cccaaatccc cgtcgggggac agtgtcacc tcaaagacta      840
agaaagcact gtgcgtcacc atgacccctgg gggccgtcct cgtgggagct gcgctggccg      900
ctggcctgct ctggaagttc atgggcagca agtgctccga ctctgggata gagtgcgact      960
cctcaggtac ctgcatcagc tcctctaact ggtgcgatgg cgtgtcacac tgcccgaacg     1020
gggaggacga gaaccggtgt gttcgcctct atggaccaaa cttcattcct caggtgtact     1080
catctcagag gaagtcctgg caccctgtat gccgagacga ctggaacgag aactacgcgc     1140
gggcagcctg cagggacatg ggctataaga atagttttta ctctagccaa ggaatagtgg     1200
ataacagtgg agccaccagc tttatgaaac tgaacacaag tgctggcaat gtcgatatct     1260
ataaaaaact gtaccacagt gatgcctgtt cttcaaaagc agtggtttct ttacgctgta     1320
tagcttgtgg ggtccgctca aacttaaacc gccagagcag gatcgtgggc ggccagaacg     1380
cgctcctggg ggcctggccc tggcaggtca gtctgcacgt ccagaacatc catgtgtgcg     1440
gaggctccat catcaccccc gagtggatcg tgacagctgc tcactgcgtg gaaaaacctc     1500
ttaacagtcc gtggcaatgg acggcattg tggggacttt gagacaatct tccatgttct     1560
atgaaaaagg acaccgagta gaaaaagtga ttctcatcc aaattatgac tccaagacca     1620
agaacaatga cattgcgctg atgaagctgc atacgcctct gactttcaac gaggtggtga     1680
aaccagtatg tctgcccaac ccaggcatga tgctggagcc ggaacagcac tgctggattt     1740
ctgggtgggg ggccacccag gagaaaggga agacctcaga cgtgctgaac gctgccatgg     1800
tgcctctcat tgagccgcgg agatgcaaca acaaatacat ctacgacgtc ctgatcacac     1860
cagccatgat ctgtgccgga ttcctgcggg ggaccgttga ttcttgccag ggtgacagtg     1920
gagggcctct ggtcactttg aagaacgatg tctggtggct gatcggggat acaagctggg     1980
gatctggctg tgcccaagct aacagaccag gagtgtacgg gaatgtgacc gtcttcacgg     2040
actgattta tcgacaaatg agggcagatg actaatcctc atggtctttg tccttgacgt     2100
cgttctacga gaaaacaaag cggctggttt tgcttcccg tgcgtgattt actcttacag     2160
atgattcaga ggtcacttca tttttattaa acagtgaact tgcctggctt tggcactctc     2220
tgccattctg tgtagtctgc agtggctcca ctgcccagcc tgttctcctt aacccttgt      2280
ccacaaggg tgatggccgg ctggttgtgg acactggtga tcaagtgtga aggagagggg     2340
tggaggctgc cccattgaga tcttcctttt gagtcctttc caggggccac tttcggatga     2400
gcatggagct gctgcctctc cgctgctgga cttgagatgg aaaaggagag acgtggaaag     2460
ggagacagcc aggtggcacc tgcagcggct gccctctggg gccacttggg tagtgtcccc     2520
agcctagttc tccacagggg gttttggatg attggttctt agtgccttag cagcccccgga     2580
tggtggctgg aaataaaggg accagcccctt catgggtggt gacgtggtag tcacttgtaa     2640
gggcaacaga aacatttttg tttttacagg gtgagaatgt agacagtgcc cttggtgcaa     2700
gggaagcaat tgcacaggca cttgcccctga gcactcctgg tgcaggtctc cacctgcaca     2760
ttgggtgggg ctccctggag attgcacatg cccctttggtc ctggcagggg gccaagtctg     2820
gcaccacgtt ggcctcttca ggcctactag tcactggaaa ttgaggtcca tgggggaaat     2880
caaggatgct cagttttagg tacactgttt ccaagttatg tttctacaca ttgctacctc     2940
aatgctcctg gaatcttagc atttgatgtc tccaagtagt ccacctacat ttaactcttt     3000
gaaactatca tcttttttgcc aagtttgagt ggtggcctat ttgagatact ttgacaaaat     3060
gattggcttc tgactttatg ttctataaat gaatgtgctg aaggaaagtg cccatggtgg     3120
cggtgaagaa gagaaagatg tgttttgttt tggactctct gtggttcctt ccaatgccgt     3180
gggtttccaa ccaggggaag ggtccctctt gtattaccaa gtgccataac catgagcact     3240
actctagcat ggttctgcct cttggccaag caggctggtt tgcaagaatg aaatgaatga     3300
ttctactgct aggacttaac cttgaaatgg aaggtcatgc aatcccattt gcaagatctg     3360
tctgtgcacg tgcctctgta gagagcagca ttcccaggca ccttggaaac aggtggcact     3420
ataaggtgcc tgctccccaa gacacatcct aaaaggtgtt ataatggtga aaacgtcttc     3480
cttctttatt gccccttttt atttatgtga gcaaccattt gtctttttg tatcttttttt     3540
aaactgtaaa gttcaattgt gaaatgaat atcatgcaaa taattatgc aattttttttt     3600
tcaaagtaa                                                            3609
```

<210> 6
<211> 3450
<212> DNA
<213> Homo sapiens
<400> 6

```
taaattgcag tcttgggtat gtctttatta ggagcatgga aacagactaa tagaataata      60
agaaggagtc atttgaggga cctctccaac aggacaggct gcaggaactg agggcaccaa     120
ccacaggagc accaagtctg gccttgcctc acctttggtc ctctgaccag cagcctcaac     180
atcacccccct tataaggaaa tggaggctgg tcctactcac caggcagaac ttcaaagatg     240
```

-continued

INFORMAL SEQUENCE LISTING

```
cagtagttac tttgaaaaaa aaattgcata atttatttgc atgatattca ttttcacaat    300
tgaactttac agtttaaaaa agatacaaaa aaagacaaac agttgttcac ataaataaga    360
aggggcaata aagaaggaag acgttttcac cattacaaca cctttttagga tgtgtcttgg   420
ggagcaagca ccttacagtg ccaactgttt ccaaggtccc tgggaatgct gctctctaca    480
gaggcatgtg cacagacaga tcctgcaaat gggattgcat gactttccat ttcaaggtta    540
agtcctagct gtagaatcat tcatttcatt cttgcaaacc agcctgcttg gccaggaggc    600
agaaccatgg tagagtagtg ctcatggtta tggcacttgg caatgcaaaa gggaccctttc    660
ccctggttgg aaacccacag cattggaagg gaccacagag agtccaaaac aaaacacatc    720
tttctcttct tcgccgccac catgggcact ttgcttcagc acattcattt atagaacgtt    780
aagtcaggag ccagtcattt tgtcaaagca gctgaaatag gccaccactc ttacttggca    840
aagatgatac agtttcaaag agttaaatga aggtggacta cttggagaca tcaaaagcta    900
agtttccagg agcactgagg tagcaatgtg tagaaacata acatggaaac agtgtacctt    960
aaactgagca tccttgattt cccccatgga cctcaatttc cagtgactag caggcctgaa   1020
gaggccaaca tggtgccaga cttggcgccc tgccaggacc aagggcatg tgcactctcc    1080
agggtgctag gagcagggtc agggaggatg aggaggaagg ctgagtctcc ctcccaggag   1140
ccccaccccaa tgtgcaggtg gagacctgca ccaggagtgc tcagggcaag ttcctttttca   1200
attgcttccc tcgcaccaag ggcactgtct atattctcac cccataagaa caaaaatgtt   1260
tctgttcccc ttacaagtga ctaccacgtc accaccatg aagggctggt cccttttattt   1320
ctggccacca tccagggctg ctaaggctct aagaaccat cagcaaaatc cccttgtgga    1380
gaggtaggct ggggacacta ccaagtggcc ccagagggca gccgctgcag gtgccacctg   1440
gctgtctccc tttccatgtc tctccttttt catctcaagt catccagcag ctgagaggtg   1500
acagctccat gctcatccaa aattggcccc tggaaaggac tcagcaggaa gatctcaatg   1560
gggcagcctc caccccctct ctccacactt gaccgccagt gcccacaacc agccggccat   1620
caccccttgc ggacaagggg ttagggagag caggctggcc aggggagcca ctgcagcctg   1680
cacagaatgg cagagagtgc caaagccaga caagttcact gtttaataaa aatgaagtga   1740
cctctgaatc atctctaaga gtaaatcatg cacggggaag caaaaccagc cccattgttt   1800
tcttgtaaaa cgacgtcaag gacgaagacc atgtggatta gccgtctgcc ctcatttgtc   1860
gataaatcca gtccgtgaat accatcacat tcccgtacac tcctggtctg taagcttgga   1920
cacagccaga accccagctt gtatcccta tcagccacca gatattgttc ttcgaagtga    1980
ccagaggccc tccactgtca ccctggcaag aatcgacgtt ccctgcagg aagcggcac     2040
agatcatggc tggtgtgatc aggttgtcat agacatatct gctgttgcat ctctgtgtct   2100
caatgagaag caccttggca gcgttcagca cttctgaggt cttcccttttc tcctcggtgg   2160
cccccacccc ggaaatccag cagagctgtt ctggctgcag catcatgcct gggttgggca   2220
gacacactgg tttcactagg tcgttgaaag tcagaggctt ctgcagcttc atcagcgcaa   2280
tgtcattgtt cttggtcttg gagtcataat ttggatgaga aatcacttttt tctacttggt   2340
atccggctcc atagaacatg aaagattgtc tcaaaatccc cgcaaatgcc gtccaatgcc   2400
atggattgtt aagaggttttt tccacgcagt gggcggctgt cacgatccac tcgggggtga   2460
tgatggagcc tccgcacacg tggacgttct ggacgtgcag gctgacctgc cagggccagg   2520
cccccgggag cgcgctctcg ccgcccacaa tcctgctctg gcggcttgag ttcaagttga   2580
ccccgcaggc tatacagcgt aaagaaacca ctgcttttga agaacaggca tcactgtggt   2640
acagtttttt atagatatcg acattgccgg cacttgtgtt cagtttcata aagctggtgg   2700
atccgctgtc atccactatt ccttggctag agtaaaaatt attcttatag cccatgtccc   2760
tgcaggccgc ccgccgtag ttctcgttcc agtcgtcttg gcacacaggg tgccaggact    2820
tcctctgaga tgagtacacc tgaaggatga agtttggtcc gtagaggcga acacaccgat   2880
tctcgtcctc cccgccgggg cagtgtgaca cgccatcaca ccagttagag gggttgatgc   2940
aggtacctga ggagtcgcac tctatcccag agttggagca cttgctgccc atgaacttcc   3000
agagtaggcc agcggccagc gcagctccca cgaggaaggt cccaggggtc aaggtgatgc   3060
acagtgcttt cttagtcttt gaggtgcaca ctgtcccgga tggggatttg ggctgcgtgc   3120
agacgacggg gttggaagcc tgcgtcagga ccctcggggc gtactggggc acggggggacg   3180
ggtagtactg agccggatgc acctcgtaga cagtggggac cacagtgggc tgtgcgggat   3240
aggggttttc cggttggtat ccatggttttt catagtaagg tccaatagct ggtggtgacc    3300
ctgagttcaa agccatcttg ctgttatcaa cagcatcgag taatgatagg tatctggaat   3360
gttcaatatg acctgccgcg ctccaggcgg cgctccccgc ccctcgccct ccgctccgc    3420
ctccgcctcc tgcttagctc gcgcctactc                                    3450
```

```
<210>  7
<211>  3250
<212>  DNA
<213>  Homo sapiens
<400>  7
tttttttttt actttgaaaa aaaaattgca taatttattt gcatgatatt cattttcaca     60
attgaactttt acagtttaaa aaagatacaa aaaaagacaa acagttgttc acataaataa    120
gaagggcaa taaagaagga agacgttttc accattacaa cacctttttag gatgtgtctt    180
ggggagcaag caccttacag tgccaactgt tccaaggtc cctgggaatg ctgctctcta    240
cagaggcatg tgcacagaca gatcctgcaa atgggattgc atgactttcc atttcaaggt   300
taagtcctag ctgtagaaatc attcatttca ttcttgcaaa ccagcctgct tggccaggag   360
gcagaaccat ggtagagtag tgctcatggt tatggcactt ggcaatgcaa aagggaccct    420
tcccctggtt ggaaacccac agcattggaa gggaccacag agtccaaa acaaaacaca    480
tctttctctt cttcgccgcc accatgggca ctttgcttca gcacattcat ttatagaacg    540
ttaagtcagg agccagtcat tttgtcaaag cagctgaaat aggccaccac tcttacttgg    600
caaagatgat acagtttcaa agagttaaat gaaggtggac tacttggaga catcaaaagc    660
taagttttcca ggagcactga ggtagcaatg tgtagaaaca taacatggaa acagtgtacc    720
ttaaactgag catccttgat ttcccccatg gacctcaatt tccagtgact agcaggcctg    780
aagaggccaa catggtgcca gacttggcgc cctgccagga ccaagggca tgtgcactct    840
ccaggtgct aggagcaggg tcagggagga tgaggaggaa ggctgagtct ccctcccagg    900
agcccccaccc aatgtgcagg tggagacctg caccaggagt gctcagggca gttcctttt    960
caattgcttc cctcgcacca agggcactgt ctatattctc accccataag aacaaaaatg   1020
```

| INFORMAL SEQUENCE LISTING |
| --- |

```
tttctgttcc ccttacaagt gactaccacg tcaccaccca tgaagggctg gtcccttat    1080
ttctggccac catccagggc tgctaaggct ctaagaaccc atcagcaaaa tcccttgtg    1140
gagaggtagg ctggggacac taccaagtgg ccccagaggg cagccgctgc aggtgccacc   1200
tggctgtctc cctttccatg tctctccttt ttcatctcaa gtcatccagc agctgagagg   1260
tgacagctcc atgctcatcc aaaattggcc cctggaaagg actcagcagg aagatctcaa   1320
tggggcagcc tccaccccct ccctccacac ttgaccgcca gtgccacaa ccagccggcc    1380
atcacccctt gcggacaagg ggttaggag agcaggctgg gcaggggagc cactgcagcc   1440
tgcacagaat ggcagagagt gccaaagcca gacaagttca ctgtttaata aaaatgaagt   1500
gacctctgaa tcatctctaa gagtaaatca tgcacgggga agcaaaacca gcccattgt    1560
tttcttgtaa aacgacgtca aggacgaaga ccatgtggat tagccgtctg ccctcatttg   1620
tcgataaatc cagtccgtga ataccatcac attcccgtac actcctggtc tgtaagcttt   1680
ggcacagcca gaaccccagc ttgtatcccc tatcagccac cagatattgt tcttcgaagt   1740
gaccagaggc cctccactgt caccctggca agaatcgacg ttcccctgca ggaagccggc   1800
acagatcatg gctggtgtga tcaggttgtc atagacatat ctgctgttgc atctctgtgt   1860
ctcaatgaga agcaccttgg cagcgttcag cacttctgag gtcttccctt tctcctcggt   1920
ggcccccac ccggaaatcc agcagagctg ttctggctgc agcatcatgc ctgggttggg    1980
cagacacact ggtttcacta ggtcgttgaa agtcagaggc ttctgcagct tcatcagcgc   2040
aatgtcattg ttcttggtct tggagtcata atttggatga gaaatcactt tttctacttg   2100
gtatccggct ccatagaaca tgaaagattg tctcaaaatc cccgcaaatg ccgtccaatg   2160
ccatggattg ttaagaggtt tttccacgca gtgggcggct gtcacgatcc actcggggt    2220
gatgatggag cctccgcaca cgtggacgtt ctggacgtgc aggctgacct gccagggcca   2280
ggcccccggg agcgcgctct cgccgcccac aatcctgctc tggcggcttg agttcaagtt   2340
gaccccgcag gctatacagc gtaaagaaac cactgctttt gaagaacagg catcactgtg   2400
gtacagtttt ttatagatat cgacattgcc ggcacttgtg ttcagtttca taaagctggt   2460
ggatccgctg tcatccacta ttccttggct agagtaaaaa ttattcttat agcccatgtc   2520
cctgcaggcc gcccgcccgt agttctcgtt ccagtcgtct tggcacacag ggtgccagga   2580
cttcctctga gatgagtaca cctgaaggat gaagtttggt ccgtagaggc gaacacaccg   2640
attctcgtcc tccccgccgg ggcagtgtga cacgccatca caccagttag aggggttgat   2700
gcaggtacct gaggagtcgc actctatccc agagttggag cacttgctgc ccatgaactt   2760
ccagagtagg ccagcggcca gcgcagctcc cacgaggaag gtcccaggg tcaaggtgat    2820
gcacagtgct ttcttagtct ttgaggtgca cactgtcccg gatggggatt tgggctgcgt   2880
gcagacgacg gggttggaag cctgcgtcag gaccctcggg gcgtactggg gcacggggga   2940
cgggtagtac tgagccggat gcacctcgta gacagtgggg accacagtgg gctgtgcggg   3000
ataggggttt tccggttggt atccatggtt ttcatagtaa ggtccaatag ctggtggtga   3060
ccctgagttc aaagccatct tgctgttatc aacagcatcg agtaatgata ggtatctgga   3120
atgttcaata tgacctgccg cgccgcgctc ctcacacccg ctttcacctc cgggcggggc   3180
aggggcatc ggcgggtccc aggcgcccag gttccctcc ccagcccgga ccccgagccg     3240
ggaccctggt                                                          3250
```

<210> 8
<211> 3175
<212> DNA
<213> Mus musculus
<400> 8

```
tttttttttt tttttaaaa gaattatata ctttattcat atatttcaca gtggaatctc      60
acagctcaga acagacacaa agcaggaaat aaccaaccaa cagcaaagac aaggagagct    120
aaggagggga caggttctca cacttcaagg tgcttgcaca tttagtctgt atgtaggtac    180
cttacagcat ctaagaaggt cccagaggac gcatgaggga gttttcttta catggagtgg    240
taaccattcc ctaggtggga gactttcccc agcaaagatg gagtcccagt tatgacccat    300
tcactgcctt ctgaagaacc aggcagagag aaggaggcag agcctcaccg tgggtaagac    360
attcatactt catatttggt aattctggca tggctttcct ggtataaacc cagggccaga    420
agaagacaga agacaatgat ctcctctctt tcatctttat ctgaagctag gaacttctaa    480
tctcattgcc agtctacaga acaacctaac catctggaag aggtctagtg tctgaggcac    540
aatcacacag tccaaatgca ggtgaactcc agacattcat ccactctagt gtccaggtgc    600
agtgaggtag taagagaaga aacacaaccc agaagcaagg tgactgaaat cacaagtccc    660
tgattctgat ggacctgagc ctccatttga ttagctgagc tatacaggct ccatcaggta    720
ctaggccatg cctgtagcca aagctaagag gtaagtttca ggctctgaga ggctgagaga    780
aacagtagtg gggagccaag aaccagactg aataacacca tgtagagctc acccaaggga    840
catgccggca ttagcttctt gctctgagag atctgcctag gcccttagct tgggaaagcc    900
tccatcaccc ttggaaaggg ccgtcatgtc aacatgcagg agagcaagcc ctttactccc    960
agccatgttc acccaggctg ttaatgaaat catgacagta tgaccagccc aacctgcaca   1020
gcagatttag gccacaggca atgggtagct ctcactctca aggtacctgt tcctgggccc   1080
aaggccctgc ctggcctcct tactcttct caggtcatca ggttactcag aggtcatagt    1140
ccttagtgat ccaaaaaagg cctgagcatg agcccaaaag aagttccaac atgagagtgc   1200
caccctcctc tgcctttggc cctatgtgcc caaacccaac agaatctggt catccattct   1260
ggtgggagct gcagaagtgg cccaggggtg gggcactgaa gccctcacag gaccagggag   1320
cacagtcaaa caagtcactg tttaataaaa gtgaaaggcc cttcgaatca tctcaaaagg   1380
tacattgtgc acaggaagtt aaaattcagg cccttggttt tcttgcagaa ggttgttgaa   1440
gacaaaggaa gtctgggaca aagccacgtg gattagctgt tcgccctcat ttgctggtag   1500
atccaatctg taaataccgt cacgttcccg tatactccag gtctgagtgc cttggcacag   1560
cccgagcccc agctcgtgtc cccaatcagc caccagatcc cattcttcaa agtaaccagc   1620
ggccctccac tgtctccctg gcaagagtcg acagaccccct ggaggaagcc ggcacagttc  1680
atggctggtg tgattaggtt gttgtatatg tatttactat tacatttgga ggctcgatc    1740
aagggtacca tggcagcatt caacacgtcc gaggtcttcc cttttctcata ggtggccccc   1800
caccccgaaa tccagcattc ctggtctagg tctagcatca tgcctgggtt cggcagacac   1860
actggcttca ctagatcatt aaaagccaaa ggtgtctgca gcttcatgag agcaatgtcg   1920
ttattcttgg tcttagagtc gtaatttgga tgggaaatta cttttctac ctggtgtcta    1980
```

| INFORMAL SEQUENCE LISTING |
| --- |

```
cttccataga acatgagaga ctgtctcaga attcccgcaa atgccgtcca gtacctcggg   2040
ctgctgaggg gttcttccac acagtgggcg gccgtcacaa tccactcggg ggtgatgatg   2100
gagcctccgc agacgtggac gccttggacg tgcaggctga cctgccaggg ccagtctcct   2160
ggtgaggcat tcaatccacc cacaatcctg ctctggcgtt tcactgagcg aaccccgcat   2220
tctatacagc gcaaagaaac caccatgcgg gatgaacatg agtcactgtg gtagagtttt   2280
ttatagaggt caacgttgcc tgagctcaca ttcagcttca taaagctcgt tgccccgctc   2340
tggtctggta tcccttggct agaataaaaa ttgttcttgt atcccatgtc tttacatgct   2400
gctctcccgt agctctcact ccaatcatcc tggcacacgg gataccaggc tttcctctga   2460
gatgagtaaa cctggaggat gaagctttgt ccgtagagac gaacacaacg gttctcatct   2520
tctccgttgg gacaatgtgc taccccgtca caccagagag aagagctgat gcatgtgcct   2580
gaagacccac actccatctc agacgtagaa cagttgctgt cccagaacct ccaaagcaag   2640
acagcagcca cagcagctcc cgtgaggaca gtgcccaggg cgagggctaa acacagcgat   2700
ttcttagact ttgaggtgca cagtgctcct gaggacttgg gatgtgtgtg gatgacagat   2760
gttgaggctt gcgttgtaat cctcggagca tactgaggca ctggagatgg gtagtactgg   2820
gctggataca agttgtagcc attgggagcc actggtggtc tcggaggaca gatgtgctca   2880
gactgatacc cgtggttctc atagcaaggt ccgattcctg gaggtgaccc tgagttcaat   2940
gccatcctgc ctgtgtcagc agcatgagga ggtcagtatg gggcttcctc caggtgacct   3000
gttgcgcttc ccgcccctct ccgcctctgt ccgagctctt ggcttcctcg tccgctccaa   3060
gtacacgacc tactccagtt ctcgcttaaa tctccggagg cggcgtcccg ggagccaggg   3120
tgacacccct aaacgcaggc acctcggcca gaaggaggga acggccagga aaggc        3175
```

<210> 9
<211> 3135
<212> DNA
<213> Rattus norvegicus
<400> 9

```
tgaacaatgg acagaattac atactttatt catacatttc acagtggaat ctcacagctc     60
agaacagaca caaaacagga aataaccaac caacagcaaa gacagggaga gctaaggagg    120
gaacatgttc tcacacttca aggtgcttgt acatttagtc ttgtaagtag gtaccttatg    180
gcatctaaga aggtccctag agtgttgttc ccagaggaag catgagggaa ctctttacat    240
ggagtggcaa ctatttcctt ggtgggagac cctccccagc aaagacggag tcccagctgt    300
gacccattca ctgccttctg aagcagccag cacagaggag gaggcagagc ctcaccatag    360
gtaagacatt catacttcat atttggtgat tgtggcatgg cttttcctgt ataaacccag    420
ggccagaaaa ggatagaaga caacgagctc ctcttttttca tctttgtcca aagcttggga    480
ctactaatcc catcgtcagt ctacagaaca acctaaccat ctggaagagg tctaatatct    540
gaggcacaag cacacagtcc aaatgcaggt gaactacaga cattcatcca gactagtgtg    600
caggtgcagt gaggtagtaa gggaataaac acaacccaga agcaaggtga ctggattcac    660
aagtccctga ttctaatgga cctcagcctc tagatgacta gctgagctat acaggctcca    720
tcaagtacca ggccttacct ggagccaaac caaagaggta agtttcaggc tgtgaaaggc    780
tgacagaaat agcggtgggg agccaagaac cagactgaat gataccatat agagctcacc    840
caagggacat gcagacatta gtttcttgct ctgaaggccc tgcctaggcc ttcagcctgg    900
caaaggttcc atcaaccttg gaatgactg tcatgtcaac atgcaggaga ataagtcctt    960
tactcctggg ctgttgttca tgaagtcatt atagtatgac cagcccaaaa ctacacagca   1020
gagctaggcc acaggcaatg ggtagtgttc tctctctctc tctctctctc tctctctctc   1080
tctctctctc tctctctctc tctctctctt tctctctctg tacctgtacc ttggcccaag   1140
gccctgcctg gcttccctac tcttctcagg tcatcagact actcagaggt catagtcctt   1200
actcatccaa aagaggcctg agcataagcc aaaaagaagt ctcaacatga gagtgccacc   1260
ttcttctgta tttggcccta tgtgcccaaa cccaacagga tctggtcatc ctttctggta   1320
ggagctgctg aagtagcctg gagggtgggg cactgaaggc ctcacaggac cagggagcac   1380
agtcagataa gtcactgttt aataaaagtg aaaggccctt tgaatcatct caaaaggtac   1440
attgtgcaca ggaagttgaa aatccgcccc ttggttttct tgcagaaggt tgttgaagac   1500
aaaggaagtc ggggacaaag ccacgtggat tagctgttcg ccctcatttg ctggtagatc   1560
caatctgtaa atactgtcac attcccgtat actccaggtc tgtatgcctt ggcacagccc   1620
gagcccagc tcgtgtccccc aatcagccac cagatttcat tcttcaaagt aaccagggggc   1680
cctccactgt ctccctgaca agagtcgaca gagccctgga ggaacccggc gcagatcatg   1740
gctggtgtga ttaagttgtt gtatatgtat ttgctattac atttggaggg ctcgatcaag   1800
ggtaccatgg cagcattcag cacatctgag gtcttccctt tctcataggt ggccccccac   1860
cctgaaatcc agcactcctg ggctaggtcc agcatcatgc ctgggttcgg cagacacact   1920
ggcttcacta catcattaaa agccaagggt gtctgcagct tcatgagagc aatgtcatta   1980
ttcttggtct tagagtcgta atttggatgg gaaatcactt ttttctacctg gtgtctactt   2040
ccatagaaca tgagagactg tttcaaaatt cccgcaaatg ccgtccagta cctagggctg   2100
ctgagggtt cttcacaca gtgggcgct gtcaacatcc actcgggt gatgatgag    2160
cctccgcaga catggatacc ttggacgtgc aggctgacct gccagggcca gtctcctggt   2220
gaggcggtcg acccacccac aatcctgctc tgacgtctta ctgagcgaac cccgcattct   2280
atacagcgca aagaaccac catgcgggat gagcacgagt cactgtggta gagtttttta    2340
tagaggtcga cgttgcctgc gctcacattc agcttcataa agtcgttgc cccgctctgg   2400
tctggtatcc cttggctaga ataaaagctg ttcttgtatc ccatgtcttt acatgctgct   2460
ctcccgtagc tctcattcca atcatcctgg cagacgggat accaggcttt cctctgagat   2520
gagtaaacct ggaggtgaa gcttgttcca tagaggcgaa cacaccggtt ctcgtcttcc    2580
ccgttgggac actgtgacac tccgtcacac cagagggagg agctgataca tgtccctgaa    2640
gacccacact ccatctctga tgaagagcac ttgctgtccc agaacttcca aagcaagcca   2700
gcagccacag cagcaccggc gaggacagtg cccagggcga ggtgacaag catgaatttc    2760
ttagatttg aggtgcacag tgttcctgag gatcgggct gtatggat ggcaggtgtt    2820
gaggcttgag ttgtgactct cggagcatac tgggcactg gagatgggca gctctgggct   2880
ggatacaagt tgtagccact gggagacaca ggtggcctcg gggaatagac gtgctcgagc   2940
tgatacccgt ggttctcata gtaaggtcca attcctggag gtgaccctga gttcaatgcc   3000
atcctgcctg tgtcagcagc atgaggaggt cagtatgtgg cttcctccag gtgacctgct   3060
```

INFORMAL SEQUENCE LISTING

```
gtgctccccg cccctctccg cctccgccgg ggctctcggt ttccttgtcc actccaagta   3120
cacgacctac tccag                                                    3135

<210>  10
<211>  3609
<212>  DNA
<213>  Macaca fascicularis
<400>  10
ttactttgaa aaaaaattg cataatttat ttgcatgata ttcattttca caattgaact      60
ttacagttta aaaaagatac aaaaaagaca aatggttgct cacataaata aaaaggggca    120
ataaagaagg aagacgtttt caccattata acacctttta ggatgtgtct tgggagcag     180
gcaccttata gtgccacctg tttccaaggt gcctgggaat gctgctctct acagaggcac    240
gtgcacagac agatcctgca aatgggattg catgaccttc catttcaagg ttaagtccta    300
gcagtagaat cattcatttc attcttgcaa accagcctgc ttggccaaga ggcagaacca    360
tgctagagta gtgctcatgg ttatggcact tggtaataca agagggaccc ttcccctggt    420
tggaaaccca cggcattgga aggaaccaca gagagtccaa aacaaaacac atctttctct    480
tcttcaccgc caccatgggc actttccttc agcacattca tttatagaac ataaagtcag    540
aagccaatca tttttgtcaaa gtatctcaaa taggccacca ctcaaacttg gcaaaaagat   600
gatagtttca aagagttaaa tgtaggtgga ctacttggag acatcaaatg ctaagattcc    660
aggagcattg aggtagcaat gtgtagaaac ataacttgga aacagtgtac ctaaaactga    720
gcatccttga tttcccccat ggacctcaat ttccagtgac tagtaggcct gaagaggcca    780
acgtggtgcc agacttggcc ccctgccagg accaagggc atgtgcaatc tccagggagc     840
cccacccaat gtgcaggtgg agacctgcac caggagtgct cagggcaagt gcctgtgcaa    900
ttgcttccct tgcaccaagg gcactgtcta cattctcacc ctgtaaaaac aaaaatgttt    960
ctgttgccct tacaagtgac taccacgtca ccacccatga agggctggtc cctttatttc   1020
cagccaccat ccggggctgc taaggcacta agaaccaatc atccaaaacc ccctgtggag   1080
aactaggctg gggacactac ccaagtggcc cagagggca gccgctgcag gtgccacctg    1140
gctgtctccc tttccacgtc tctccttttc catctcaagt ccagcagcgg agaggcagca   1200
gctccatgct catccgaaag tggcccctgg aaaggactca aaaggaagat ctcaatgggg   1260
cagcctccac ccctctcctt cacacttgac caccagtgtc cacaaccagc ggccatcac    1320
cccttgtgga caaggggtta aggagaacag gctgggcagt ggagccactg cagactacac   1380
agaatggcag agagtgccaa agccaggcaa gttcactgtt taataaaaat gaagtgacct   1440
ctgaatcatc tgtaagagta aatcacgcac ggggaagcaa aaccagccgc tttgttttct   1500
cgtagaacga cgtcaaggac aaagaccatg aggattagtc atctgccctc atttgtcgat   1560
aaatccagtc cgtgaagacg gtcacattcc cgtacactcc tggtctgtta gcttgggcac   1620
agccagatcc ccagcttgta tccccgatca gccaccagac atcgttcttc aaagtgacca   1680
gaggccctcc actgtcaccc tggcaagaat caacggtccc ccgcaggaat ccggcacaga   1740
tcatggctgg tgtgatcagg ccgtcgtaga tgtatttgtt gttgcatctc cgcggctcaa   1800
tgagaggcac catggcagcg ttcagcacgt ctgaggtctt ccctttctcc tgggtggccc   1860
cccacccaga aatccagcag tgctgttccg gctccagcat catgcctggg ttgggcagac   1920
atactggttt caccacctcg ttgaaagtca gaggcgtatg cagcttcatc agcgcaatgt   1980
cattgttctt ggtcttggag tcataatttg gatgagaaat cactttttct actcggtgtc   2040
cttttttcata gaacatggaa gattgtctca aagtccccac aaatgccgtc cattgccacg   2100
gactgttaag aggttttttcc acgcagtgag cagctgtcac gatccactcg ggggtgatga   2160
tggagcctcc gcacacatgg atgttctgga cgtgcagact gacctgccag ggccaggccc    2220
ccaggagcgc gttctggccg cccacgatcc tgctctggcg gtttaagttt gagcggaccc    2280
cacaagctat acagcgtaaa gaaaccactg cttttgaaga acaggcatca ctgtggtaca    2340
gttttttata gatatcgaca ttgccagcac ttgtgttcag tttcataaag ctggtggctc     2400
cactgttatc cactattcct tggctagagt aaaaactatt cttatagcc atgtccctgc     2460
aggctgcccg cgcgtagttc tcgttccagt cgtctcggca tacagggtgc caggacttcc    2520
tctgagatga gtacacctga agaatgaagt ttggtccata gaggcgaaca caccggttct    2580
cgtcctcccc gttcgggcag tgtgacacgc catcgcacca gttagaggag ctgatgcagg    2640
tacctgagga gtcgcactct atcccagagt cggagcactt gctgcccatg aacttccaga    2700
gcaggccagc ggccagcgca gctcccacga ggacggcccc cagggtcatg gtgacgcaca    2760
gtgctttctt agtctttgag gtgcacactg tccccgacgg ggatttgggc tgcctgcaga    2820
cggcggggtt ggaagcatgc gtcaggaccc tcgggggtgta ctgggggtacg ggggacgggt   2880
agtactgagc cggatgcacc tcgtagacat tggggggccac ggtgggctgt gcaggatagg    2940
ggttttccgg ttggtatcca tggttttcgt agtaaggtcc aacacctggc ggtgaccctg    3000
agttcaaagc catcttgctt ttatcaacag catcgagtaa tgataggtat ctggaatgtt    3060
cagtatgacc tatgtctgct ttgtgaagag agaggatccc caggcctgac atcaacacaa    3120
taaatcccgc attcttgtct cataagcagg agagaactca gtaccgtcct aagattgctt    3180
tcaaagagtc ctgcctaacc aaaacacatt tcacgcctct ggtttctcag ctctcctatc    3240
tcccagtta taggtttggt tgaagtttca ggaagtgaaa attcgatccc attggcggct    3300
ctcccagctc agaagccctc tgaaaggaat gaagaatcag tgctcaaaac ccacacttgc    3360
tattcattca cgatccctaa caaggaagcc agggaaggaa ggaacaccgg gagccaccac    3420
cattaattgt caaataaaag ccacgggacc cagaggcagt ggcaggataa tcctatctct    3480
tccagcaatc agaacatgat aaacaaaaat attcagcgtg cccaaatcag ctaccatgga    3540
ctttgaaatg gaagaccaga gtgatgctgc caataacgtt ctccagctgg gtcgggcgtg    3600
gtgactcac                                                           3609
```

SEQUENCE LISTING (1516 sequences)

SEQ ID NO: 1 - DNA, 3450 bp, Homo sapiens
  source 1..3450: mol_type = unassigned DNA
gagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagtaactactgcatctttgaagttctgcctggtgagtaggaccagcctccatttccttataagggggtgatgttgaggctgctggtcagaggaccaaaggtgaggcaaggccagacttggtgctcctgtggttggtgccctcagttcctgcagcctgtcctgttggagaggtccctcaaatgactccttcttattattctattagtctgtttccatgctcctaataaagacatacccaagactgcaattta

SEQ ID NO: 2 - DNA, 3250 bp, Homo sapiens
  source 1..3250: mol_type = unassigned DNA
accagggtcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagtaaaaaaaaaa

SEQ ID NO: 3 - DNA, 3175 bp, Mus musculus
  source 1..3175: mol_type = unassigned DNA
gcctttcctggccgttccctccttctggccgaggtgcctgcgtttaggggtgtcaccctggctcccgggacgccgcctccggagatttaagcgagaactggagtaggtcgtgtacttggagcggacgaggaagccaagagctcggacagaggcggagaggggcgggaagcgcaacaggtcacctggaggaagccccatactgacctcctcatgctgctgacacaggcaggatggcattgaactcagggtcacctccaggaatcggaccttgctatgagaaccacgggtatcagtctgagcacatctgtcctccgagaccaccagtggctcccaatggctacaacttgtatccagcccagtactacccatctccagtgcctcagtatgctccgaggattacaacgcaagcctcaacatctgtcatccacacacatcccaagtcctcaggagcactgtgcacctcaaagtctaagaaatcgctgtgtttagccctcgccctgggcactgtcctcacgggagctgctgtggctgctgtcttgctttggaggttctgggacagcaactgttctacgtctgagatggagtgtgggtcttcaggcacatgcatcagctcttctctctggtgtgacggggtagcacattgtcccaacggagaagatgagaaccgttgtgttcgtctctacggacaaagcttcatcctccaggtttactcatctcagaggaaagcctggtatcccgtgtgccaggatgattggagtgagagctacgggagagcagcatgtaaagacatgggatacaagaacaatttttattctagccaagggataccagaccagagcggggcaacgagctttatgaagctgaatgtgagctcaggcaacgttgacctctataaaaaactctaccacagtgactcatgttcatcccgcatggtggtttctttgcgctgtatagaatgcggggttcgctcagtgaaacgccagagcaggattgtgggtggattgaatgcctcaccaggagactggccctggcaggtcagcctgcacgtccaaggcgtccacgtctgcggaggctccatcatcacccccgagtggattgtgacggccgcccactgtgtggaagaacccctcagcagcccgaggtactggacggcatttgcgggaattctgagacagtctctcatgttctatggaagtagacaccaggtagaaaaagtaatttcccatccaaattacgactctaagaccaagaataacgacattgctctcatgaagctgcagacacctttggcttttaatgatctagtgaagccagtgtgtctgccgaacccaggcatgatgctagacctagaccaggaatgctggatttcggggtggggggccacctatgagaaagggaagacctcggacgtgttgaatgctgccatggtacccttgatcgagccctccaaatgtaatagtaaatacatatacaacaacctaatcacaccagccatgatctgtgccggcttcctccaggggtctgtcgactcttgccagggagacagtggagggccgctggttactttgaagaatgggatctggtggctgattggggacacgagctggggctcgggctgtgccaaggcactcagacctggagtatacgggaacgtgacggtatttacagattggatctaccagcaaatgagggcgaacagctaatccacgtggctttgtcccagacttcctttgtcttcaacaaccttctgcaagaaaaccaagggcctgaattttaacttcctgtgcacaatgtaccttttgagatgattcgaagggcctttcacttttattaaacagtgacttgtttgactgtgctccctggtcctgtgagggcttcagtgccccacccctgggccacttctgcagctcccaccagaatggatgaccagattctgttgggtttgggcacatagggccaaaggcagaggagggtggcactctcatgttggaacttcttttgggctcatgctcaggccttttttggatcactaaggactatgacctctgagtaacctgatgacctgagaaagagtaaggaggccaggcagggccttgggcccaggaacaggtaccttgagagtgagagctacccattgcctgtggcctaaatctgctgtgcaggttgggctggtcatactgtcatgatttcattaacagcctgggtgaacatggctgggagtaaagggcttgctctcctgcatgttgacatgacggccctttccaagggtgatggaggctttcccaagctaagggcctaggcagatctctcagagcaagaagctaatgccggcatgtcccttgggtgagctctacatggtgttattcagtctggttcttggctccccactactgtttctctcagcctctcagagcctgaaacttacctcttagctttggctacaggcatggcctagtacctgatggagcctgtatagctcagctaatcaaatggaggctcaggtccatcagaatcagggacttgtgatttcagtcaccttgcttctgggttgtgtttcttctcttactacctcactgcacctggacactagagtggatgaatgtctggagttcacctgcatttggactgtgtgattgtgcctcagacactagacctcttccagatggttaggttgttctgtagactggcaatgagattagaagttcctagcttcagataaagatgaaagagaggagatcattgtcttctgtcttcttctggccctgggtttataccaggaaagccatgccagaattaccaaatatgaagtatgaatgtcttacccacggtgaggctctgcctccttctctctgcctggttcttcagaaggcagtgaatgggtcataactgggactccatctttgctggggaaagtctcccacctagggaatggttaccactccatgtaaagaaaactccctcatgcgtcctctgggaccttcttagatgctgtaaggtacctacatacagactaaatgtgcaagcaccttgaagtgtgagaacctgtcccctccttagctctccttgtctttgctgttggttggttatttcctgctttgtgtctgttctgagctgtgagattccactgtgaaatatatgaataaagtatataattcttttaaaaaaaaaaaaaaaa

SEQ ID NO: 4 - DNA, 3135 bp, Rattus norvegicus
  source 1..3135: mol_type = unassigned DNA
ctggagtaggtcgtgtacttggagtggacaaggaaaccgagagccccggcggaggcggagaggggcggggagcacagcaggtcacctggaggaagccacatactgacctcctcatgctgctgacacaggcaggatggcattgaactcagggtcacctccaggaattggaccttactatgagaaccacgggtatcagtctgagcacgtctattccccgaggccacctgtgtctcccagtggctacaacttgtatccagcccagagctgcccatctccagtgccccagtatgctccgagagtcacaactcaagcctcaacacctgccatccacatacagccccgatcctcaggaacactgtgcacctcaaaatctaagaaatccatgcttgtcgccctggccctgggcactgtcctcgccggtgctgctgtggctgctggcttgctttggaagttctgggacagcaagtgctcttcatcagagatggagtgtgggtcttcagggacatgtatcagctcctccctctggtgtgacggagtgtcacagtgtcccaacggggaagacgagaaccggtgtgttcgcctctatggaacaagcttcaccctccaggtttactcatctcagaggaaagcctggtatcccgtctgccaggatgattggaatgagagctacgggagagcagcatgtaaagacatgggatacaagaacagcttttattctagccaagggataccagaccagagcggggcaacgagctttatgaagctgaatgtgagcgcaggcaacgtcgacctctataaaaaactctaccacagtgactcgtgctcatcccgcatggtggtttctttgcgctgtatagaatgcggggttcgctcagtaagacgtcagagcaggattgtgggtgggtcgaccgcctcaccaggagactggccctggcaggtcagcctgcacgtccaaggtatccatgtctgcggaggctccatcatcacccccgagtggattgtgacagccgcccactgtgtggaagaacccctcagcagccctaggtactggacggcatttgcgggaattttgaaacagtctctcatgttctatggaagtagacaccaggtagaaaaagtgatttcccatccaaattacgactctaagaccaagaataatgacattgctctcatgaagctgcagacacccttggcttttaatgatgtagtgaagccagtgtgtctgccgaacccaggcatgatgctggacctagcccaggagtgctggatttcagggtggggggccacctatgagaaagggaagacctcagatgtgctgaatgctgccatggtacccttgatcgagccctccaaatgtaatagcaaatacatatacaacaacttaatcacaccagccatgatctgcgccgggttcctccagggctctgtcgactcttgtcagggagacagtggagggcccctggttactttgaagaatgaaatctggtggctgattggggacacgagctggggctcgggctgtgccaaggcatacagacctggagtatacgggaatgtgacagtatttacagattggatctaccagcaaatgagggcgaacagctaatccacgtggctttgtccccgacttcctttgtcttcaacaaccttctgcaagaaaaccaaggggcggattttcaacttcctgtgcacaatgtaccttttgagatgattcaaagggcctttcacttttattaaacagtgacttatctgactgtgctccctggtcctgtgagggcttcagtgccccaccctccaggctacttcagcagctcctaccagaaaggatgaccagatcctgttgggtttgggcacatagggccaaatacagaagaaggtggcactctcatgttgagacttctttttggcttatgctcaggcctcttttggatgagtaaggactatgacctctgagtagtctgatgacctgagaagagtagggaagccaggcagggccttgggccaaggtacaggtacagagagagaaagagagagagagagagagagagagagagagagagagagagagagagagagagagagagagaacactacccattgcctgtggcctagctctgctgtgtagttttgggctggtcatactataatgacttcatgaacaacagcccaggagtaaaggacttattctcctgcatgttgacatgacagtcatttccaaggttgatggaacctttgccaggctgagggcctaggcagggccttcagagcaagaaactaatgtctgcatgtcccttgggtgagctctatatggtatcattcagtctggttcttggctccccaccgctatttctgtcagcctttcacagcctgaaacttacctctttggtttggctccaggtaaggcctggtacttgatggagcctgtatagctcagctagtcatctagaggctgaggtccattagaatcagggacttgtgaatccagtcaccttgcttctgggttgtgtttattcccttactacctcactgcacctgcacactagtctggatgaatgtctgtagttcacctgcatttggactgtgtgcttgtgcctcagatattagacctcttccagatggttaggttgttctgtagactgacgatgggattagtagtcccaagctttggacaaagatgaaaaagaggagctcgttgtcttctatccttttctggccctgggtttataccaggaaagccatgccacaatcaccaaatatgaagtatgaatgtcttacctatggtgaggctctgcctcctcctctgtgcctggctcttcagaaggcagtgaatgggtcacagctgggactccgtctttgctggggagggtctcccaccaaggaaatagttgccactccatgtaaagagttccctcatgcttcctctgggaacaacactctagggaccttcttagatgccataaggtacctacttacaagactaaatgtacaagcaccttgaagtgtgagaacatgttccctccttagctctccctgtctttgctgttggttggttatttcctgttttgtgtctgttctgagctgtgagattccactgtgaaatgtatgaataaagtatgtaattctgtccattgttca

SEQ ID NO: 5 - DNA, 3609 bp, Macaca fascicularis
  source 1..3609: mol_type = unassigned DNA
gtgagtcaccacgcccgacccagctggagaacgttattggcagcatcactctggtcttccatttcaaagtccatggtagctgatttgggcacgctgaatatttttgtttatcatgttctgattgctggaagagataggattatcctgccactgcctctgggtcccgtggcttttatttgacaattaatggtggtggctcccggtgttccttccttccctggcttccttgttagggatcgtgaatgaatagcaagtgtgggttttgagcactgattcttcattcctttcagagggcttctgagctgggagagccgccaatgggatcgaattttcacttcctgaaacttcaaccaaacctataactggggagataggagagctgagaaaccagaggcgtgagaatgtgtttggttaggcaggactctttgaaagcaatcttaggacggtactgagttctctcctgcttatgagacaagaatgcgggatttattgtgttgatgtcaggcctgaggatcctctctcttcacaaagcagacataggtcatactgaacattccagatacctatcattactcgatgctgttgataaaagcaagatggctttgaactcagggtcaccgccaggtgttggaccttactacgaaaaccatggataccaaccggaaaacccctatcctgcacagcccaccgtggcccccaatgtctacgaggtgcatccggctcagtactacccgtcccccgtaccccagtacaccccgagggtcctgacgcatgcttccaaccccgccgtctgcaggcagcccaaatccccgtcggggacagtgtgcacctcaaagactaagaaagcactgtgcgtcaccatgaccctgggggccgtcctcgtgggagctgcgctggccgctggcctgctctggaagttcatgggcagcaagtgctccgactctgggatagagtgcgactcctcaggtacctgcatcagctcctctaactggtgcgatggcgtgtcacactgcccgaacggggaggacgagaaccggtgtgttcgcctctatggaccaaacttcattcttcaggtgtactcatctcagaggaagtcctggcaccctgtatgccgagacgactggaacgagaactacgcgcgggcagcctgcagggacatgggctataagaatagtttttactctagccaaggaatagtggataacagtggagccaccagctttatgaaactgaacacaagtgctggcaatgtcgatatctataaaaaactgtaccacagtgatgcctgttcttcaaaagcagtggtttctttacgctgtatagcttgtggggtccgctcaaacttaaaccgccagagcaggatcgtgggcggccagaacgcgctcctgggggcctggccctggcaggtcagtctgcacgtccagaacatccatgtgtgcggaggctccatcatcacccccgagtggatcgtgacagctgctcactgcgtggaaaaacctcttaacagtccgtggcaatggacggcatttgtggggactttgagacaatcttccatgttctatgaaaaaggacaccgagtagaaaaagtgatttctcatccaaattatgactccaagaccaagaacaatgacattgcgctgatgaagctgcatacgcctctgactttcaacgaggtggtgaaaccagtatgtctgcccaacccaggcatgatgctggagccggaacagcactgctggatttctgggtggggggccacccaggagaaagggaagacctcagacgtgctgaacgctgccatggtgcctctcattgagccgcggagatgcaacaacaaatacatctacgacggcctgatcacaccagccatgatctgtgccggattcctgcgggggaccgttgattcttgccagggtgacagtggagggcctctggtcactttgaagaacgatgtctggtggctgatcggggatacaagctggggatctggctgtgcccaagctaacagaccaggagtgtacgggaatgtgaccgtcttcacggactggatttatcgacaaatgagggcagatgactaatcctcatggtctttgtccttgacgtcgttctacgagaaaacaaagcggctggttttgcttccccgtgcgtgatttactcttacagatgattcagaggtcacttcatttttattaaacagtgaacttgcctggctttggcactctctgccattctgtgtagtctgcagtggctccactgcccagcctgttctccttaaccccttgtccacaaggggtgatggccggctggttgtggacactggtggtcaagtgtgaaggagaggggtggaggctgccccattgagatcttccttttgagtcctttccaggggccactttcggatgagcatggagctgctgcctctccgctgctggacttgagatggaaaaggagagacgtggaaagggagacagccaggtggcacctgcagcggctgccctctggggccacttgggtagtgtccccagcctagttctccacagggggttttggatgattggttcttagtgccttagcagccccggatggtggctggaaataaagggaccagcccttcatgggtggtgacgtggtagtcacttgtaagggcaacagaaacatttttgtttttacagggtgagaatgtagacagtgcccttggtgcaagggaagcaattgcacaggcacttgccctgagcactcctggtgcaggtctccacctgcacattgggtggggctccctggagattgcacatgccccttggtcctggcagggggccaagtctggcaccacgttggcctcttcaggcctactagtcactggaaattgaggtccatgggggaaatcaaggatgctcagttttaggtacactgtttccaagttatgtttctacacattgctacctcaatgctcctggaatcttagcatttgatgtctccaagtagtccacctacatttaactctttgaaactatcatctttttgccaagtttgagtggtggcctatttgagatactttgacaaaatgattggcttctgactttatgttctataaatgaatgtgctgaaggaaagtgcccatggtggcggtgaagaagagaaagatgtgttttgttttggactctctgtggttccttccaatgccgtgggtttccaaccaggggaagggtccctcttgtattaccaagtgccataaccatgagcactactctagcatggttctgcctcttggccaagcaggctggtttgcaagaatgaaatgaatgattctactgctaggacttaaccttgaaatggaaggtcatgcaatcccatttgcaggatctgtctgtgcacgtgcctctgtagagagcagcattcccaggcaccttggaaacaggtggcactataaggtgcctgctccccaagacacatcctaaaaggtgttataatggtgaaaacgtcttccttctttattgcccctttttatttatgtgagcaaccatttgtcttttttgtatcttttttaaactgtaaagttcaattgtgaaaatgaatatcatgcaaataaattatgcaatttttttttcaaagtaa

SEQ ID NO: 6 - DNA, 3450 bp, Homo sapiens
  source 1..3450: mol_type = unassigned DNA
taaattgcagtcttgggtatgtctttattaggagcatggaaacagactaatagaataataagaaggagtcatttgagggacctctccaacaggacaggctgcaggaactgagggcaccaaccacaggagcaccaagtctggccttgcctcacctttggtcctctgaccagcagcctcaacatcacccccttataaggaaatggaggctggtcctactcaccaggcagaacttcaaagatgcagtagttactttgaaaaaaaaattgcataatttatttgcatgatattcattttcacaattgaactttacagtttaaaaaagatacaaaaaaagacaaacagttgttcacataaataagaaggggcaataaagaaggaagacgttttcaccattacaacaccttttaggatgtgtcttggggagcaagcaccttacagtgccaactgtttccaaggtccctgggaatgctgctctctacagaggcatgtgcacagacagatcctgcaaatgggattgcatgactttccatttcaaggttaagtcctagctgtagaatcattcatttcattcttgcaaaccagcctgcttggccaggaggcagaaccatggtagagtagtgctcatggttatggcacttggcaatgcaaaagggacccttcccctggttggaaacccacagcattggaagggaccacagagagtccaaaacaaaacacatctttctcttcttcgccgccaccatgggcactttgcttcagcacattcatttatagaacgttaagtcaggagccagtcattttgtcaaagcagctgaaataggccaccactcttacttggcaaagatgatacagtttcaaagagttaaatgaaggtggactacttggagacatcaaaagctaagtttccaggagcactgaggtagcaatgtgtagaaacataacatggaaacagtgtaccttaaactgagcatccttgatttcccccatggacctcaatttccagtgactagcaggcctgaagaggccaacatggtgccagacttggcgccctgccaggaccaaggggcatgtgcactctccagggtgctaggagcagggtcagggaggatgaggaggaaggctgagtctccctcccaggagccccacccaatgtgcaggtggagacctgcaccaggagtgctcagggcaagttccttttcaattgcttccctcgcaccaagggcactgtctatattctcaccccataagaacaaaaatgtttctgttccccttacaagtgactaccacgtcaccacccatgaagggctggtccctttatttctggccaccatccagggctgctaaggctctaagaacccatcagcaaaatccccttgtggagaggtaggctggggacactaccaagtggccccagagggcagccgctgcaggtgccacctggctgtctccctttccatgtctctcctttttcatctcaagtcatccagcagctgagaggtgacagctccatgctcatccaaaattggcccctggaaaggactcagcaggaagatctcaatggggcagcctccacccctctcctccacacttgaccgccagtgcccacaaccagccggccatcaccccttgcggacaaggggttagggagagcaggctgggcaggggagccactgcagcctgcacagaatggcagagagtgccaaagccagacaagttcactgtttaataaaaatgaagtgacctctgaatcatctctaagagtaaatcatgcacggggaagcaaaaccagccccattgttttcttgtaaaacgacgtcaaggacgaagaccatgtggattagccgtctgccctcatttgtcgataaatccagtccgtgaataccatcacattcccgtacactcctggtctgtaagctttggcacagccagaaccccagcttgtatcccctatcagccaccagatattgttcttcgaagtgaccagaggccctccactgtcaccctggcaagaatcgacgttcccctgcaggaagccggcacagatcatggctggtgtgatcaggttgtcatagacatatctgctgttgcatctctgtgtctcaatgagaagcaccttggcagcgttcagcacttctgaggtcttccctttctcctcggtggccccccacccggaaatccagcagagctgttctggctgcagcatcatgcctgggttgggcagacacactggtttcactaggtcgttgaaagtcagaggcttctgcagcttcatcagcgcaatgtcattgttcttggtcttggagtcataatttggatgagaaatcactttttctacttggtatccggctccatagaacatgaaagattgtctcaaaatccccgcaaatgccgtccaatgccatggattgttaagaggtttttccacgcagtgggcggctgtcacgatccactcgggggtgatgatggagcctccgcacacgtggacgttctggacgtgcaggctgacctgccagggccaggcccccgggagcgcgctctcgccgcccacaatcctgctctggcggcttgagttcaagttgaccccgcaggctatacagcgtaaagaaaccactgcttttgaagaacaggcatcactgtggtacagttttttatagatatcgacattgccggcacttgtgttcagtttcataaagctggtggatccgctgtcatccactattccttggctagagtaaaaattattcttatagcccatgtccctgcaggccgcccgcccgtagttctcgttccagtcgtcttggcacacagggtgccaggacttcctctgagatgagtacacctgaaggatgaagtttggtccgtagaggcgaacacaccgattctcgtcctccccgccggggcagtgtgacacgccatcacaccagttagaggggttgatgcaggtacctgaggagtcgcactctatcccagagttggagcacttgctgcccatgaacttccagagtaggccagcggccagcgcagctcccacgaggaaggtccccagggtcaaggtgatgcacagtgctttcttagtctttgaggtgcacactgtcccggatggggatttgggctgcgtgcagacgacggggttggaagcctgcgtcaggaccctcggggcgtactggggcacgggggacgggtagtactgagccggatgcacctcgtagacagtggggaccacagtgggctgtgcgggataggggttttccggttggtatccatggttttcatagtaaggtccaatagctggtggtgaccctgagttcaaagccatcttgctgttatcaacagcatcgagtaatgataggtatctggaatgttcaatatgacctgccgcgctccaggcggcgctccccgcccctcgccctccgcctccgcctccgcctcctgcttagctcgcgcctactc

SEQ ID NO: 7 - DNA, 3250 bp, Homo sapiens
  source 1..3250: mol_type = unassigned DNA
ttttttttttactttgaaaaaaaaattgcataatttatttgcatgatattcattttcacaattgaactttacagtttaaaaaagatacaaaaaaagacaaacagttgttcacataaataagaaggggcaataaagaaggaagacgttttcaccattacaacaccttttaggatgtgtcttggggagcaagcaccttacagtgccaactgtttccaaggtccctgggaatgctgctctctacagaggcatgtgcacagacagatcctgcaaatgggattgcatgactttccatttcaaggttaagtcctagctgtagaatcattcatttcattcttgcaaaccagcctgcttggccaggaggcagaaccatggtagagtagtgctcatggttatggcacttggcaatgcaaaagggacccttcccctggttggaaacccacagcattggaagggaccacagagagtccaaaacaaaacacatctttctcttcttcgccgccaccatgggcactttgcttcagcacattcatttatagaacgttaagtcaggagccagtcattttgtcaaagcagctgaaataggccaccactcttacttggcaaagatgatacagtttcaaagagttaaatgaaggtggactacttggagacatcaaaagctaagtttccaggagcactgaggtagcaatgtgtagaaacataacatggaaacagtgtaccttaaactgagcatccttgatttcccccatggacctcaatttccagtgactagcaggcctgaagaggccaacatggtgccagacttggcgccctgccaggaccaaggggcatgtgcactctccagggtgctaggagcagggtcagggaggatgaggaggaaggctgagtctccctcccaggagccccacccaatgtgcaggtggagacctgcaccaggagtgctcagggcaagttccttttcaattgcttccctcgcaccaagggcactgtctatattctcaccccataagaacaaaaatgtttctgttccccttacaagtgactaccacgtcaccacccatgaagggctggtccctttatttctggccaccatccagggctgctaaggctctaagaacccatcagcaaaatccccttgtggagaggtaggctggggacactaccaagtggccccagagggcagccgctgcaggtgccacctggctgtctccctttccatgtctctcctttttcatctcaagtcatccagcagctgagaggtgacagctccatgctcatccaaaattggcccctggaaaggactcagcaggaagatctcaatggggcagcctccacccctctcctccacacttgaccgccagtgcccacaaccagccggccatcaccccttgcggacaaggggttagggagagcaggctgggcaggggagccactgcagcctgcacagaatggcagagagtgccaaagccagacaagttcactgtttaataaaaatgaagtgacctctgaatcatctctaagagtaaatcatgcacggggaagcaaaaccagccccattgttttcttgtaaaacgacgtcaaggacgaagaccatgtggattagccgtctgccctcatttgtcgataaatccagtccgtgaataccatcacattcccgtacactcctggtctgtaagctttggcacagccagaaccccagcttgtatcccctatcagccaccagatattgttcttcgaagtgaccagaggccctccactgtcaccctggcaagaatcgacgttcccctgcaggaagccggcacagatcatggctggtgtgatcaggttgtcatagacatatctgctgttgcatctctgtgtctcaatgagaagcaccttggcagcgttcagcacttctgaggtcttccctttctcctcggtggccccccacccggaaatccagcagagctgttctggctgcagcatcatgcctgggttgggcagacacactggtttcactaggtcgttgaaagtcagaggcttctgcagcttcatcagcgcaatgtcattgttcttggtcttggagtcataatttggatgagaaatcactttttctacttggtatccggctccatagaacatgaaagattgtctcaaaatccccgcaaatgccgtccaatgccatggattgttaagaggtttttccacgcagtgggcggctgtcacgatccactcgggggtgatgatggagcctccgcacacgtggacgttctggacgtgcaggctgacctgccagggccaggcccccgggagcgcgctctcgccgcccacaatcctgctctggcggcttgagttcaagttgaccccgcaggctatacagcgtaaagaaaccactgcttttgaagaacaggcatcactgtggtacagttttttatagatatcgacattgccggcacttgtgttcagtttcataaagctggtggatccgctgtcatccactattccttggctagagtaaaaattattcttatagcccatgtccctgcaggccgcccgcccgtagttctcgttccagtcgtcttggcacacagggtgccaggacttcctctgagatgagtacacctgaaggatgaagtttggtccgtagaggcgaacacaccgattctcgtcctccccgccggggcagtgtgacacgccatcacaccagttagaggggttgatgcaggtacctgaggagtcgcactctatcccagagttggagcacttgctgcccatgaacttccagagtaggccagcggccagcgcagctcccacgaggaaggtccccagggtcaaggtgatgcacagtgctttcttagtctttgaggtgcacactgtcccggatggggatttgggctgcgtgcagacgacggggttggaagcctgcgtcaggaccctcggggcgtactggggcacgggggacgggtagtactgagccggatgcacctcgtagacagtggggaccacagtgggctgtgcgggataggggttttccggttggtatccatggttttcatagtaaggtccaatagctggtggtgaccctgagttcaaagccatcttgctgttatcaacagcatcgagtaatgataggtatctggaatgttcaatatgacctgccgcgccgcgctcctcacacccgctttcacctccgggcggggcagggggcatcggcgggtcccaggcgcccaggttcccctccccagcccggaccccgagccgggaccctggt

SEQ ID NO: 8 - DNA, 3175 bp, Mus musculus
  source 1..3175: mol_type = unassigned DNA
ttttttttttttttttaaaagaattatatactttattcatatatttcacagtggaatctcacagctcagaacagacacaaagcaggaaataaccaaccaacagcaaagacaaggagagctaaggaggggacaggttctcacacttcaaggtgcttgcacatttagtctgtatgtaggtaccttacagcatctaagaaggtcccagaggacgcatgagggagttttctttacatggagtggtaaccattccctaggtgggagactttccccagcaaagatggagtcccagttatgacccattcactgccttctgaagaaccaggcagagagaaggaggcagagcctcaccgtgggtaagacattcatacttcatatttggtaattctggcatggctttcctggtataaacccagggccagaagaagacagaagacaatgatctcctctctttcatctttatctgaagctaggaacttctaatctcattgccagtctacagaacaacctaaccatctggaagaggtctagtgtctgaggcacaatcacacagtccaaatgcaggtgaactccagacattcatccactctagtgtccaggtgcagtgaggtagtaagagaagaaacacaacccagaagcaaggtgactgaaatcacaagtccctgattctgatggacctgagcctccatttgattagctgagctatacaggctccatcaggtactaggccatgcctgtagccaaagctaagaggtaagtttcaggctctgagaggctgagagaaacagtagtggggagccaagaaccagactgaataacaccatgtagagctcacccaagggacatgccggcattagcttcttgctctgagagatctgcctaggcccttagcttgggaaagcctccatcacccttggaaagggccgtcatgtcaacatgcaggagagcaagccctttactcccagccatgttcacccaggctgttaatgaaatcatgacagtatgaccagcccaacctgcacagcagatttaggccacaggcaatgggtagctctcactctcaaggtacctgttcctgggcccaaggccctgcctggcctccttactctttctcaggtcatcaggttactcagaggtcatagtccttagtgatccaaaaaaggcctgagcatgagcccaaaagaagttccaacatgagagtgccaccctcctctgcctttggccctatgtgcccaaacccaacagaatctggtcatccattctggtgggagctgcagaagtggcccaggggtggggcactgaagccctcacaggaccagggagcacagtcaaacaagtcactgtttaataaaagtgaaaggcccttcgaatcatctcaaaaggtacattgtgcacaggaagttaaaattcaggcccttggttttcttgcagaaggttgttgaagacaaaggaagtctgggacaaagccacgtggattagctgttcgccctcatttgctggtagatccaatctgtaaataccgtcacgttcccgtatactccaggtctgagtgccttggcacagcccgagccccagctcgtgtccccaatcagccaccagatcccattcttcaaagtaaccagcggccctccactgtctccctggcaagagtcgacagacccctggaggaagccggcacagatcatggctggtgtgattaggttgttgtatatgtatttactattacatttggagggctcgatcaagggtaccatggcagcattcaacacgtccgaggtcttccctttctcataggtggccccccaccccgaaatccagcattcctggtctaggtctagcatcatgcctgggttcggcagacacactggcttcactagatcattaaaagccaaaggtgtctgcagcttcatgagagcaatgtcgttattcttggtcttagagtcgtaatttggatgggaaattactttttctacctggtgtctacttccatagaacatgagagactgtctcagaattcccgcaaatgccgtccagtacctcgggctgctgaggggttcttccacacagtgggcggccgtcacaatccactcgggggtgatgatggagcctccgcagacgtggacgccttggacgtgcaggctgacctgccagggccagtctcctggtgaggcattcaatccacccacaatcctgctctggcgtttcactgagcgaaccccgcattctatacagcgcaaagaaaccaccatgcgggatgaacatgagtcactgtggtagagttttttatagaggtcaacgttgcctgagctcacattcagcttcataaagctcgttgccccgctctggtctggtatcccttggctagaataaaaattgttcttgtatcccatgtctttacatgctgctctcccgtagctctcactccaatcatcctggcacacgggataccaggctttcctctgagatgagtaaacctggaggatgaagctttgtccgtagagacgaacacaacggttctcatcttctccgttgggacaatgtgctaccccgtcacaccagagagaagagctgatgcatgtgcctgaagacccacactccatctcagacgtagaacagttgctgtcccagaacctccaaagcaagacagcagccacagcagctcccgtgaggacagtgcccagggcgagggctaaacacagcgatttcttagactttgaggtgcacagtgctcctgaggacttgggatgtgtgtggatgacagatgttgaggcttgcgttgtaatcctcggagcatactgaggcactggagatgggtagtactgggctggatacaagttgtagccattgggagccactggtggtctcggaggacagatgtgctcagactgatacccgtggttctcatagcaaggtccgattcctggaggtgaccctgagttcaatgccatcctgcctgtgtcagcagcatgaggaggtcagtatggggcttcctccaggtgacctgttgcgcttcccgcccctctccgcctctgtccgagctcttggcttcctcgtccgctccaagtacacgacctactccagttctcgcttaaatctccggaggcggcgtcccgggagccagggtgacacccctaaacgcaggcacctcggccagaaggagggaacggccaggaaaggc

SEQ ID NO: 9 - DNA, 3135 bp, Rattus norvegicus
  source 1..3135: mol_type = unassigned DNA
tgaacaatggacagaattacatactttattcatacatttcacagtggaatctcacagctcagaacagacacaaaacaggaaataaccaaccaacagcaaagacagggagagctaaggagggaacatgttctcacacttcaaggtgcttgtacatttagtcttgtaagtaggtaccttatggcatctaagaaggtccctagagtgttgttcccagaggaagcatgagggaactctttacatggagtggcaactatttccttggtgggagaccctccccagcaaagacggagtcccagctgtgacccattcactgccttctgaagagccaggcacagaggaggaggcagagcctcaccataggtaagacattcatacttcatatttggtgattgtggcatggctttcctggtataaacccagggccagaaaaggatagaagacaacgagctcctctttttcatctttgtccaaagcttgggactactaatcccatcgtcagtctacagaacaacctaaccatctggaagaggtctaatatctgaggcacaagcacacagtccaaatgcaggtgaactacagacattcatccagactagtgtgcaggtgcagtgaggtagtaagggaataaacacaacccagaagcaaggtgactggattcacaagtccctgattctaatggacctcagcctctagatgactagctgagctatacaggctccatcaagtaccaggccttacctggagccaaaccaaagaggtaagtttcaggctgtgaaaggctgacagaaatagcggtggggagccaagaaccagactgaatgataccatatagagctcacccaagggacatgcagacattagtttcttgctctgaaggccctgcctaggccctcagcctggcaaaggttccatcaaccttggaaatgactgtcatgtcaacatgcaggagaataagtcctttactcctgggctgttgttcatgaagtcattatagtatgaccagcccaaaactacacagcagagctaggccacaggcaatgggtagtgttctctctctctctctctctctctctctctctctctctctctctctctctctctctctctctttctctctctgtacctgtaccttggcccaaggccctgcctggcttccctactcttctcaggtcatcagactactcagaggtcatagtccttactcatccaaaagaggcctgagcataagccaaaaagaagtctcaacatgagagtgccaccttcttctgtatttggccctatgtgcccaaacccaacaggatctggtcatcctttctggtaggagctgctgaagtagcctggagggtggggcactgaagccctcacaggaccagggagcacagtcagataagtcactgtttaataaaagtgaaaggccctttgaatcatctcaaaaggtacattgtgcacaggaagttgaaaatccgccccttggttttcttgcagaaggttgttgaagacaaaggaagtcggggacaaagccacgtggattagctgttcgccctcatttgctggtagatccaatctgtaaatactgtcacattcccgtatactccaggtctgtatgccttggcacagcccgagccccagctcgtgtccccaatcagccaccagatttcattcttcaaagtaaccaggggccctccactgtctccctgacaagagtcgacagagccctggaggaacccggcgcagatcatggctggtgtgattaagttgttgtatatgtatttgctattacatttggagggctcgatcaagggtaccatggcagcattcagcacatctgaggtcttccctttctcataggtggccccccaccctgaaatccagcactcctgggctaggtccagcatcatgcctgggttcggcagacacactggcttcactacatcattaaaagccaagggtgtctgcagcttcatgagagcaatgtcattattcttggtcttagagtcgtaatttggatgggaaatcactttttctacctggtgtctacttccatagaacatgagagactgtttcaaaattcccgcaaatgccgtccagtacctagggctgctgaggggttcttccacacagtgggcggctgtcacaatccactcgggggtgatgatggagcctccgcagacatggataccttggacgtgcaggctgacctgccagggccagtctcctggtgaggcggtcgacccacccacaatcctgctctgacgtcttactgagcgaaccccgcattctatacagcgcaaagaaaccaccatgcgggatgagcacgagtcactgtggtagagttttttatagaggtcgacgttgcctgcgctcacattcagcttcataaagctcgttgccccgctctggtctggtatcccttggctagaataaaagctgttcttgtatcccatgtctttacatgctgctctcccgtagctctcattccaatcatcctggcagacgggataccaggctttcctctgagatgagtaaacctggagggtgaagcttgttccatagaggcgaacacaccggttctcgtcttccccgttgggacactgtgacactccgtcacaccagagggaggagctgatacatgtccctgaagacccacactccatctctgatgaagagcacttgctgtcccagaacttccaaagcaagccagcagccacagcagcaccggcgaggacagtgcccagggccagggcgacaagcatggatttcttagattttgaggtgcacagtgttcctgaggatcggggctgtatgtggatggcaggtgttgaggcttgagttgtgactctcggagcatactggggcactggagatgggcagctctgggctggatacaagttgtagccactgggagacacaggtggcctcggggaatagacgtgctcagactgatacccgtggttctcatagtaaggtccaattcctggaggtgaccctgagttcaatgccatcctgcctgtgtcagcagcatgaggaggtcagtatgtggcttcctccaggtgacctgctgtgctccccgcccctctccgcctccgccggggctctcggtttccttgtccactccaagtacacgacctactccag

SEQ ID NO: 10 - DNA, 3609 bp, Macaca fascicularis
  source 1..3609: mol_type = unassigned DNA
ttactttgaaaaaaaaattgcataatttatttgcatgatattcattttcacaattgaactttacagtttaaaaaagatacaaaaaagacaaatggttgctcacataaataaaaaggggcaataaagaaggaagacgttttcaccattataacaccttttaggatgtgtcttggggagcaggcaccttatagtgccacctgtttccaaggtgcctgggaatgctgctctctacagaggcacgtgcacagacagatcctgcaaatgggattgcatgaccttccatttcaaggttaagtcctagcagtagaatcattcatttcattcttgcaaaccagcctgcttggccaagaggcagaaccatgctagagtagtgctcatggttatggcacttggtaatacaagagggacccttcccctggttggaaacccacggcattggaaggaaccacagagagtccaaaacaaaacacatctttctcttcttcaccgccaccatgggcactttccttcagcacattcatttatagaacataaagtcagaagccaatcattttgtcaaagtatctcaaataggccaccactcaaacttggcaaaaagatgatagtttcaaagagttaaatgtaggtggactacttggagacatcaaatgctaagattccaggagcattgaggtagcaatgtgtagaaacataacttggaaacagtgtacctaaaactgagcatccttgatttcccccatggacctcaatttccagtgactagtaggcctgaagaggccaacgtggtgccagacttggccccctgccaggaccaaggggcatgtgcaatctccagggagccccacccaatgtgcaggtggagacctgcaccaggagtgctcagggcaagtgcctgtgcaattgcttcccttgcaccaagggcactgtctacattctcaccctgtaaaaacaaaaatgtttctgttgcccttacaagtgactaccacgtcaccacccatgaagggctggtccctttatttccagccaccatccggggctgctaaggcactaagaaccaatcatccaaaaccccctgtggagaactaggctggggacactacccaagtggccccagagggcagccgctgcaggtgccacctggctgtctccctttccacgtctctccttttccatctcaagtccagcagcggagaggcagcagctccatgctcatccgaaagtggcccctggaaaggactcaaaaggaagatctcaatggggcagcctccacccctctccttcacacttgaccaccagtgtccacaaccagccggccatcaccccttgtggacaaggggttaaggagaacaggctgggcagtggagccactgcagactacacagaatggcagagagtgccaaagccaggcaagttcactgtttaataaaaatgaagtgacctctgaatcatctgtaagagtaaatcacgcacggggaagcaaaaccagccgctttgttttctcgtagaacgacgtcaaggacaaagaccatgaggattagtcatctgccctcatttgtcgataaatccagtccgtgaagacggtcacattcccgtacactcctggtctgttagcttgggcacagccagatccccagcttgtatccccgatcagccaccagacatcgttcttcaaagtgaccagaggccctccactgtcaccctggcaagaatcaacggtcccccgcaggaatccggcacagatcatggctggtgtgatcaggccgtcgtagatgtatttgttgttgcatctccgcggctcaatgagaggcaccatggcagcgttcagcacgtctgaggtcttccctttctcctgggtggccccccacccagaaatccagcagtgctgttccggctccagcatcatgcctgggttgggcagacatactggtttcaccacctcgttgaaagtcagaggcgtatgcagcttcatcagcgcaatgtcattgttcttggtcttggagtcataatttggatgagaaatcactttttctactcggtgtcctttttcatagaacatggaagattgtctcaaagtccccacaaatgccgtccattgccacggactgttaagaggtttttccacgcagtgagcagctgtcacgatccactcgggggtgatgatggagcctccgcacacatggatgttctggacgtgcagactgacctgccagggccaggcccccaggagcgcgttctggccgcccacgatcctgctctggcggtttaagtttgagcggaccccacaagctatacagcgtaaagaaaccactgcttttgaagaacaggcatcactgtggtacagttttttatagatatcgacattgccagcacttgtgttcagtttcataaagctggtggctccactgttatccactattccttggctagagtaaaaactattcttatagcccatgtccctgcaggctgcccgcgcgtagttctcgttccagtcgtctcggcatacagggtgccaggacttcctctgagatgagtacacctgaagaatgaagtttggtccatagaggcgaacacaccggttctcgtcctccccgttcgggcagtgtgacacgccatcgcaccagttagaggagctgatgcaggtacctgaggagtcgcactctatcccagagtcggagcacttgctgcccatgaacttccagagcaggccagcggccagcgcagctcccacgaggacggcccccagggtcatggtgacgcacagtgctttcttagtctttgaggtgcacactgtccccgacggggatttgggctgcctgcagacggcggggttggaagcatgcgtcaggaccctcggggtgtactggggtacgggggacgggtagtactgagccggatgcacctcgtagacattgggggccacggtgggctgtgcaggataggggttttccggttggtatccatggttttcgtagtaaggtccaacacctggcggtgaccctgagttcaaagccatcttgcttttatcaacagcatcgagtaatgataggtatctggaatgttcagtatgacctatgtctgctttgtgaagagagaggatcctcaggcctgacatcaacacaataaatcccgcattcttgtctcataagcaggagagaactcagtaccgtcctaagattgctttcaaagagtcctgcctaaccaaacacattctcacgcctctggtttctcagctctcctatctccccagttataggtttggttgaagtttcaggaagtgaaaattcgatcccattggcggctctcccagctcagaagccctctgaaaggaatgaagaatcagtgctcaaaacccacacttgctattcattcacgatccctaacaaggaagccagggaaggaaggaacaccgggagccaccaccattaattgtcaaataaaagccacgggacccagaggcagtggcaggataatcctatctcttccagcaatcagaacatgataaacaaaaatattcagcgtgcccaaatcagctaccatggactttgaaatggaagaccagagtgatgctgccaataacgttctccagctgggtcgggcgtggtgactcac

SEQ ID NO: 11 - protein, 16 aa, unidentified
  source 1..16: note = Description of Unknown: RFGF peptide
AAVALLPAVLLALLAP

SEQ ID NO: 12 - protein, 11 aa, unidentified
  source 1..11: note = Description of Unknown: RFGF analogue peptide
AALLPVLLAAP

SEQ ID NO: 13 - protein, 13 aa, Human immunodeficiency virus
GRKKRRQRRRPPQ

SEQ ID NO: 14 - protein, 16 aa, Drosophila sp.
RQIKIWFQNRRMKWKK

SEQ ID NO: 15 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphate
  modified_base 2: mod_base = OTHER; note = 2'-O-methyluridine-3'-phosphate
  modified_base 3: mod_base = OTHER; note = 2'-O-methyluridine-3'-phosphate
  modified_base 5: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 12: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 20: mod_base = OTHER; note = 2'-deoxythymidine-3'-phosphorothioate
  misc_feature 1..19: note = RNA
  misc_feature 20..21: note = DNA
cttacgctgagtacttcgatt

SEQ ID NO: 16 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 7: mod_base = OTHER; note = 2'-O-methyluridine-3'-phosphate
  modified_base 11: mod_base = OTHER; note = 2'-O-methylcytidine-3'-phosphate
  modified_base 16: mod_base = OTHER; note = 2'-O-methyluridine-3'-phosphate
  modified_base 20: mod_base = OTHER; note = 2'-deoxythymidine-3'-phosphorothioate
  misc_feature 1..19: note = RNA
  misc_feature 20..21: note = DNA
tcgaagtactcagcgtaagtt

SEQ ID NO: 17 - RNA, 21 nt, synthetic construct
  source 1..21: mol_type = other RNA; note = Description of Artificial Sequence: Synthetic oligonucleotide
ttcatttaactctttgaaaca

SEQ ID NO: 18 - RNA, 21 nt, synthetic construct
  source 1..21: mol_type = other RNA; note = Description of Artificial Sequence: Synthetic oligonucleotide
aaacgtcttccttctttatta

SEQ ID NO: 19 - RNA, 21 nt, synthetic construct
  source 1..21: mol_type = other RNA; note = Description of Artificial Sequence: Synthetic oligonucleotide
aacgtcttccttctttattga

SEQ ID NO: 20 - RNA, 21 nt, synthetic construct
  source 1..21: mol_type = other RNA; note = Description of Artificial Sequence: Synthetic oligonucleotide
tggtgaaaacgtcttccttca

SEQ ID NO: 21 - RNA, 21 nt, synthetic construct
  source 1..21: mol_type = other RNA; note = Description of Artificial Sequence: Synthetic oligonucleotide
tggtttctttacgctgtataa

SEQ ID NO: 22 - RNA, 21 nt, synthetic construct
  source 1..21: mol_type = other RNA; note = Description of Artificial Sequence: Synthetic oligonucleotide
ttccagatacctatcattaca

SEQ ID NO: 23 - RNA, 21 nt, synthetic construct
  source 1..21: mol_type = other RNA; note = Description of Artificial Sequence: Synthetic oligonucleotide
tccagatacctatcattacta

SEQ ID NO: 24 - RNA, 21 nt, synthetic construct
  source 1..21: mol_type = other RNA; note = Description of Artificial Sequence: Synthetic oligonucleotide
cagatacctatcattactcga

SEQ ID NO: 25 - RNA, 21 nt, synthetic construct
  source 1..21: mol_type = other RNA; note = Description of Artificial Sequence: Synthetic oligonucleotide
gatacctatcattactcgata

SEQ ID NO: 26 - RNA, 21 nt, synthetic construct
  source 1..21: mol_type = other RNA; note = Description of Artificial Sequence: Synthetic oligonucleotide
cgtggaaaaacctcttaacaa

SEQ ID NO: 27 - RNA, 21 nt, synthetic construct
  source 1..21: mol_type = other RNA; note = Description of Artificial Sequence: Synthetic oligonucleotide
agtgatttctcatccaaatta

SEQ ID NO: 28 - RNA, 21 nt, synthetic construct
  source 1..21: mol_type = other RNA; note = Description of Artificial Sequence: Synthetic oligonucleotide
tctcatccaaattatgactca

SEQ ID NO: 29 - RNA, 21 nt, synthetic construct
  source 1..21: mol_type = other RNA; note = Description of Artificial Sequence: Synthetic oligonucleotide
atccaaattatgactccaaga

SEQ ID NO: 30 - RNA, 21 nt, synthetic construct
  source 1..21: mol_type = other RNA; note = Description of Artificial Sequence: Synthetic oligonucleotide
actggatttatcgacaaatga

SEQ ID NO: 31 - RNA, 21 nt, synthetic construct
  source 1..21: mol_type = other RNA; note = Description of Artificial Sequence: Synthetic oligonucleotide
tttgatgtctccaagtagtca

SEQ ID NO: 32 - RNA, 21 nt, synthetic construct
  source 1..21: mol_type = other RNA; note = Description of Artificial Sequence: Synthetic oligonucleotide
caagacacatcctaaaaggta

SEQ ID NO: 33 - RNA, 21 nt, synthetic construct
  source 1..21: mol_type = other RNA; note = Description of Artificial Sequence: Synthetic oligonucleotide
gtaatggtgaaaacgtcttca

SEQ ID NO: 34 - RNA, 21 nt, synthetic construct
  source 1..21: mol_type = other RNA; note = Description of Artificial Sequence: Synthetic oligonucleotide
tgaaaacgtcttccttcttta

SEQ ID NO: 35 - RNA, 21 nt, synthetic construct
  source 1..21: mol_type = other RNA; note = Description of Artificial Sequence: Synthetic oligonucleotide
gaaaacgtcttccttctttaa

SEQ ID NO: 36 - RNA, 21 nt, synthetic construct
  source 1..21: mol_type = other RNA; note = Description of Artificial Sequence: Synthetic oligonucleotide
aactgtaaagttcaattgtga

SEQ ID NO: 37 - RNA, 21 nt, synthetic construct
  source 1..21: mol_type = other RNA; note = Description of Artificial Sequence: Synthetic oligonucleotide
gtactcatctcagaggaagta

SEQ ID NO: 38 - RNA, 21 nt, synthetic construct
  source 1..21: mol_type = other RNA; note = Description of Artificial Sequence: Synthetic oligonucleotide
cggcaatgtcgatatctataa

SEQ ID NO: 39 - RNA, 21 nt, synthetic construct
  source 1..21: mol_type = other RNA; note = Description of Artificial Sequence: Synthetic oligonucleotide
ggcaatgtcgatatctataaa

SEQ ID NO: 40 - RNA, 21 nt, synthetic construct
  source 1..21: mol_type = other RNA; note = Description of Artificial Sequence: Synthetic oligonucleotide
gcaatgtcgatatctataaaa

SEQ ID NO: 41 - RNA, 21 nt, synthetic construct
  source 1..21: mol_type = other RNA; note = Description of Artificial Sequence: Synthetic oligonucleotide
caatgtcgatatctataaaaa

SEQ ID NO: 42 - RNA, 21 nt, synthetic construct
  source 1..21: mol_type = other RNA; note = Description of Artificial Sequence: Synthetic oligonucleotide
gtggtttctttacgctgtata

SEQ ID NO: 43 - RNA, 21 nt, synthetic construct
  source 1..21: mol_type = other RNA; note = Description of Artificial Sequence: Synthetic oligonucleotide
attccagatacctatcattaa

SEQ ID NO: 44 - RNA, 21 nt, synthetic construct
  source 1..21: mol_type = other RNA; note = Description of Artificial Sequence: Synthetic oligonucleotide
ccagatacctatcattactca

SEQ ID NO: 45 - RNA, 21 nt, synthetic construct
  source 1..21: mol_type = other RNA; note = Description of Artificial Sequence: Synthetic oligonucleotide
agatacctatcattactcgaa

SEQ ID NO: 46 - RNA, 21 nt, synthetic construct
  source 1..21: mol_type = other RNA; note = Description of Artificial Sequence: Synthetic oligonucleotide
gtgatttctcatccaaattaa

SEQ ID NO: 47 - RNA, 21 nt, synthetic construct
  source 1..21: mol_type = other RNA; note = Description of Artificial Sequence: Synthetic oligonucleotide
tgatttctcatccaaattata

SEQ ID NO: 48 - RNA, 21 nt, synthetic construct
  source 1..21: mol_type = other RNA; note = Description of Artificial Sequence: Synthetic oligonucleotide
atttctcatccaaattatgaa

SEQ ID NO: 49 - RNA, 21 nt, synthetic construct
  source 1..21: mol_type = other RNA; note = Description of Artificial Sequence: Synthetic oligonucleotide
tttctcatccaaattatgaca

SEQ ID NO: 50 - RNA, 21 nt, synthetic construct
  source 1..21: mol_type = other RNA; note = Description of Artificial Sequence: Synthetic oligonucleotide
ttctcatccaaattatgacta

SEQ ID NO: 51 - RNA, 21 nt, synthetic construct
  source 1..21: mol_type = other RNA; note = Description of Artificial Sequence: Synthetic oligonucleotide
aggtcacttcatttttattaa

SEQ ID NO: 52 - RNA, 21 nt, synthetic construct
  source 1..21: mol_type = other RNA; note = Description of Artificial Sequence: Synthetic oligonucleotide
atgtttctacacattgctaca

SEQ ID NO: 53 - RNA, 21 nt, synthetic construct
  source 1..21: mol_type = other RNA; note = Description of Artificial Sequence: Synthetic oligonucleotide
tcatttaactctttgaaacta

SEQ ID NO: 54 - RNA, 21 nt, synthetic construct
  source 1..21: mol_type = other RNA; note = Description of Artificial Sequence: Synthetic oligonucleotide
ctaggacttaaccttgaaata

SEQ ID NO: 55 - RNA, 21 nt, synthetic construct
  source 1..21: mol_type = other RNA; note = Description of Artificial Sequence: Synthetic oligonucleotide
agacacatcctaaaaggtgta

SEQ ID NO: 56 - RNA, 21 nt, synthetic construct
  source 1..21: mol_type = other RNA; note = Description of Artificial Sequence: Synthetic oligonucleotide
gacacatcctaaaaggtgtta

SEQ ID NO: 57 - RNA, 21 nt, synthetic construct
  source 1..21: mol_type = other RNA; note = Description of Artificial Sequence: Synthetic oligonucleotide
atggtgaaaacgtcttcctta

SEQ ID NO: 58 - RNA, 21 nt, synthetic construct
  source 1..21: mol_type = other RNA; note = Description of Artificial Sequence: Synthetic oligonucleotide
gtgaaaacgtcttccttctta

SEQ ID NO: 59 - RNA, 21 nt, synthetic construct
  source 1..21: mol_type = other RNA; note = Description of Artificial Sequence: Synthetic oligonucleotide
aaaacgtcttccttctttata

SEQ ID NO: 60 - RNA, 21 nt, synthetic construct
  source 1..21: mol_type = other RNA; note = Description of Artificial Sequence: Synthetic oligonucleotide
atgcctgttcttcaaaagcaa

SEQ ID NO: 61 - RNA, 21 nt, synthetic construct
  source 1..21: mol_type = other RNA; note = Description of Artificial Sequence: Synthetic oligonucleotide
gcctgttcttcaaaagcagta

SEQ ID NO: 62 - RNA, 21 nt, synthetic construct
  source 1..21: mol_type = other RNA; note = Description of Artificial Sequence: Synthetic oligonucleotide
ttcaaaagcagtggtttctta

SEQ ID NO: 63 - RNA, 21 nt, synthetic construct
  source 1..21: mol_type = other RNA; note = Description of Artificial Sequence: Synthetic oligonucleotide
ctatcattactcgatgctgta

SEQ ID NO: 64 - RNA, 21 nt, synthetic construct
  source 1..21: mol_type = other RNA; note = Description of Artificial Sequence: Synthetic oligonucleotide
tgcgtggaaaaacctcttaaa

SEQ ID NO: 65 - RNA, 21 nt, synthetic construct
  source 1..21: mol_type = other RNA; note = Description of Artificial Sequence: Synthetic oligonucleotide
caagtagaaaaagtgatttca

SEQ ID NO: 66 - RNA, 21 nt, synthetic construct
  source 1..21: mol_type = other RNA; note = Description of Artificial Sequence: Synthetic oligonucleotide
aagtagaaaaagtgatttcta

SEQ ID NO: 67 - RNA, 21 nt, synthetic construct
  source 1..21: mol_type = other RNA; note = Description of Artificial Sequence: Synthetic oligonucleotide
gtagaaaaagtgatttctcaa

SEQ ID NO: 68 - RNA, 21 nt, synthetic construct
  source 1..21: mol_type = other RNA; note = Description of Artificial Sequence: Synthetic oligonucleotide
tagaaaaagtgatttctcata

SEQ ID NO: 69 - RNA, 21 nt, synthetic construct
  source 1..21: mol_type = other RNA; note = Description of Artificial Sequence: Synthetic oligonucleotide
aaaagtgatttctcatccaaa

SEQ ID NO: 70 - RNA, 21 nt, synthetic construct
  source 1..21: mol_type = other RNA; note = Description of Artificial Sequence: Synthetic oligonucleotide
gatttctcatccaaattatga

SEQ ID NO: 71 - RNA, 21 nt, synthetic construct
  source 1..21: mol_type = other RNA; note = Description of Artificial Sequence: Synthetic oligonucleotide
aagcctctgactttcaacgaa

SEQ ID NO: 72 - RNA, 21 nt, synthetic construct
  source 1..21: mol_type = other RNA; note = Description of Artificial Sequence: Synthetic oligonucleotide
gctagtcactggaaattgaga

SEQ ID NO: 73 - RNA, 21 nt, synthetic construct
  source 1..21: mol_type = other RNA; note = Description of Artificial Sequence: Synthetic oligonucleotide
ttttgatgtctccaagtagta

SEQ ID NO: 74 - RNA, 21 nt, synthetic construct
  source 1..21: mol_type = other RNA; note = Description of Artificial Sequence: Synthetic oligonucleotide
gatgtgttttgttttggacta

SEQ ID NO: 75 - RNA, 21 nt, synthetic construct
  source 1..21: mol_type = other RNA; note = Description of Artificial Sequence: Synthetic oligonucleotide
ttttgttttggactctctgta

SEQ ID NO: 76 - RNA, 21 nt, synthetic construct
  source 1..21: mol_type = other RNA; note = Description of Artificial Sequence: Synthetic oligonucleotide
gctggtttgcaagaatgaaaa

SEQ ID NO: 77 - RNA, 21 nt, synthetic construct
  source 1..21: mol_type = other RNA; note = Description of Artificial Sequence: Synthetic oligonucleotide
tggtttgcaagaatgaaatga

SEQ ID NO: 78 - RNA, 21 nt, synthetic construct
  source 1..21: mol_type = other RNA; note = Description of Artificial Sequence: Synthetic oligonucleotide
ggtttgcaagaatgaaatgaa

SEQ ID NO: 79 - RNA, 21 nt, synthetic construct
  source 1..21: mol_type = other RNA; note = Description of Artificial Sequence: Synthetic oligonucleotide
taggacttaaccttgaaatga

SEQ ID NO: 80 - RNA, 21 nt, synthetic construct
  source 1..21: mol_type = other RNA; note = Description of Artificial Sequence: Synthetic oligonucleotide
ggtgaaaacgtcttccttcta

SEQ ID NO: 81 - RNA, 21 nt, synthetic construct
  source 1..21: mol_type = other RNA; note = Description of Artificial Sequence: Synthetic oligonucleotide
acgtcttccttctttattgca

SEQ ID NO: 82 - RNA, 21 nt, synthetic construct
  source 1..21: mol_type = other RNA; note = Description of Artificial Sequence: Synthetic oligonucleotide
cgtcttccttctttattgcca

SEQ ID NO: 83 - RNA, 21 nt, synthetic construct
  source 1..21: mol_type = other RNA; note = Description of Artificial Sequence: Synthetic oligonucleotide
ctgtaaagttcaattgtgaaa

SEQ ID NO: 84 - RNA, 21 nt, synthetic construct
  source 1..21: mol_type = other RNA; note = Description of Artificial Sequence: Synthetic oligonucleotide
gcacctcaaagactaagaaaa

SEQ ID NO: 85 - RNA, 21 nt, synthetic construct
  source 1..21: mol_type = other RNA; note = Description of Artificial Sequence: Synthetic oligonucleotide
cacctcaaagactaagaaaga

SEQ ID NO: 86 - RNA, 21 nt, synthetic construct
  source 1..21: mol_type = other RNA; note = Description of Artificial Sequence: Synthetic oligonucleotide
atccaccagctttatgaaaca

SEQ ID NO: 87 - RNA, 21 nt, synthetic construct
  source 1..21: mol_type = other RNA; note = Description of Artificial Sequence: Synthetic oligonucleotide
tgatgcctgttcttcaaaaga

SEQ ID NO: 88 - RNA, 21 nt, synthetic construct
  source 1..21: mol_type = other RNA; note = Description of Artificial Sequence: Synthetic oligonucleotide
gatgcctgttcttcaaaagca

SEQ ID NO: 89 - RNA, 21 nt, synthetic construct
  source 1..21: mol_type = other RNA; note = Description of Artificial Sequence: Synthetic oligonucleotide
tgcctgttcttcaaaagcaga

SEQ ID NO: 90 - RNA, 21 nt, synthetic construct
  source 1..21: mol_type = other RNA; note = Description of Artificial Sequence: Synthetic oligonucleotide
tcttcaaaagcagtggtttca

SEQ ID NO: 91 - RNA, 21 nt, synthetic construct
  source 1..21: mol_type = other RNA; note = Description of Artificial Sequence: Synthetic oligonucleotide
cattccagatacctatcatta

SEQ ID NO: 92 - RNA, 21 nt, synthetic construct
  source 1..21: mol_type = other RNA; note = Description of Artificial Sequence: Synthetic oligonucleotide
acctatcattactcgatgcta

SEQ ID NO: 93 - RNA, 21 nt, synthetic construct
  source 1..21: mol_type = other RNA; note = Description of Artificial Sequence: Synthetic oligonucleotide
gcgtggaaaaacctcttaaca

SEQ ID NO: 94 - RNA, 21 nt, synthetic construct
  source 1..21: mol_type = other RNA; note = Description of Artificial Sequence: Synthetic oligonucleotide
cattactcgatgctgttgata

SEQ ID NO: 95 - RNA, 21 nt, synthetic construct
  source 1..21: mol_type = other RNA; note = Description of Artificial Sequence: Synthetic oligonucleotide
ttactcgatgctgttgataaa

SEQ ID NO: 96 - RNA, 21 nt, synthetic construct
  source 1..21: mol_type = other RNA; note = Description of Artificial Sequence: Synthetic oligonucleotide
aagaacaatgacattgcgcta

SEQ ID NO: 97 - RNA, 21 nt, synthetic construct
  source 1..21: mol_type = other RNA; note = Description of Artificial Sequence: Synthetic oligonucleotide
acagcaagatggctttgaaca

SEQ ID NO: 98 - RNA, 21 nt, synthetic construct
  source 1..21: mol_type = other RNA; note = Description of Artificial Sequence: Synthetic oligonucleotide
cagcaagatggctttgaacta

SEQ ID NO: 99 - RNA, 21 nt, synthetic construct
  source 1..21: mol_type = other RNA; note = Description of Artificial Sequence: Synthetic oligonucleotide
tcagaggtcacttcattttta

SEQ ID NO: 100 - RNA, 21 nt, synthetic construct
  source 1..21: mol_type = other RNA; note = Description of Artificial Sequence: Synthetic oligonucleotide
cagaggtcacttcatttttaa

SEQ ID NO: 101 - RNA, 21 nt, synthetic construct
  source 1..21: mol_type = other RNA; note = Description of Artificial Sequence: Synthetic oligonucleotide
tgttatgtttctacacattga

SEQ ID NO: 102 - RNA, 21 nt, synthetic construct
  source 1..21: mol_type = other RNA; note = Description of Artificial Sequence: Synthetic oligonucleotide
tatgtttctacacattgctaa

SEQ ID NO: 103 - RNA, 21 nt, synthetic construct
  source 1..21: mol_type = other RNA; note = Description of Artificial Sequence: Synthetic oligonucleotide
acgttctataaatgaatgtga

SEQ ID NO: 104 - RNA, 21 nt, synthetic construct
  source 1..21: mol_type = other RNA; note = Description of Artificial Sequence: Synthetic oligonucleotide
gttttgttttggactctctga

SEQ ID NO: 105 - RNA, 21 nt, synthetic construct
  source 1..21: mol_type = other RNA; note = Description of Artificial Sequence: Synthetic oligonucleotide
gtttgcaagaatgaaatgaaa

SEQ ID NO: 106 - RNA, 21 nt, synthetic construct
  source 1..21: mol_type = other RNA; note = Description of Artificial Sequence: Synthetic oligonucleotide
aagaatgaaatgaatgattca

SEQ ID NO: 107 - RNA, 21 nt, synthetic construct
  source 1..21: mol_type = other RNA; note = Description of Artificial Sequence: Synthetic oligonucleotide
gctaggacttaaccttgaaaa

SEQ ID NO: 108 - RNA, 21 nt, synthetic construct
  source 1..21: mol_type = other RNA; note = Description of Artificial Sequence: Synthetic oligonucleotide
aagacacatcctaaaaggtga

SEQ ID NO: 109 - RNA, 21 nt, synthetic construct
  source 1..21: mol_type = other RNA; note = Description of Artificial Sequence: Synthetic oligonucleotide
tgtaatggtgaaaacgtctta

SEQ ID NO: 110 - RNA, 21 nt, synthetic construct
  source 1..21: mol_type = other RNA; note = Description of Artificial Sequence: Synthetic oligonucleotide
aatggtgaaaacgtcttccta

SEQ ID NO: 111 - RNA, 21 nt, synthetic construct
  source 1..21: mol_type = other RNA; note = Description of Artificial Sequence: Synthetic oligonucleotide
actgtaaagttcaattgtgaa

SEQ ID NO: 112 - RNA, 21 nt, synthetic construct
  source 1..21: mol_type = other RNA; note = Description of Artificial Sequence: Synthetic oligonucleotide
tgtaaagttcaattgtgaaaa

SEQ ID NO: 113 - RNA, 21 nt, synthetic construct
  source 1..21: mol_type = other RNA; note = Description of Artificial Sequence: Synthetic oligonucleotide
acctcaaagactaagaaagca

SEQ ID NO: 114 - RNA, 21 nt, synthetic construct
  source 1..21: mol_type = other RNA; note = Description of Artificial Sequence: Synthetic oligonucleotide
cctcaaagactaagaaagcaa

SEQ ID NO: 115 - RNA, 21 nt, synthetic construct
  source 1..21: mol_type = other RNA; note = Description of Artificial Sequence: Synthetic oligonucleotide
ctcaaagactaagaaagcaca

SEQ ID NO: 116 - RNA, 21 nt, synthetic construct
  source 1..21: mol_type = other RNA; note = Description of Artificial Sequence: Synthetic oligonucleotide
caccagctttatgaaactgaa

SEQ ID NO: 117 - RNA, 21 nt, synthetic construct
  source 1..21: mol_type = other RNA; note = Description of Artificial Sequence: Synthetic oligonucleotide
ccggcaatgtcgatatctata

SEQ ID NO: 118 - RNA, 21 nt, synthetic construct
  source 1..21: mol_type = other RNA; note = Description of Artificial Sequence: Synthetic oligonucleotide
gttcttcaaaagcagtggtta

SEQ ID NO: 119 - RNA, 21 nt, synthetic construct
  source 1..21: mol_type = other RNA; note = Description of Artificial Sequence: Synthetic oligonucleotide
cttcaaaagcagtggtttcta

SEQ ID NO: 120 - RNA, 21 nt, synthetic construct
  source 1..21: mol_type = other RNA; note = Description of Artificial Sequence: Synthetic oligonucleotide
ttgaacattccagatacctaa

SEQ ID NO: 121 - RNA, 21 nt, synthetic construct
  source 1..21: mol_type = other RNA; note = Description of Artificial Sequence: Synthetic oligonucleotide
acattccagatacctatcata

SEQ ID NO: 122 - RNA, 21 nt, synthetic construct
  source 1..21: mol_type = other RNA; note = Description of Artificial Sequence: Synthetic oligonucleotide
tcattactcgatgctgttgaa

SEQ ID NO: 123 - RNA, 21 nt, synthetic construct
  source 1..21: mol_type = other RNA; note = Description of Artificial Sequence: Synthetic oligonucleotide
agtagaaaaagtgatttctca

SEQ ID NO: 124 - RNA, 21 nt, synthetic construct
  source 1..21: mol_type = other RNA; note = Description of Artificial Sequence: Synthetic oligonucleotide
ctccaagaccaagaacaatga

SEQ ID NO: 125 - RNA, 21 nt, synthetic construct
  source 1..21: mol_type = other RNA; note = Description of Artificial Sequence: Synthetic oligonucleotide
caagaccaagaacaatgacaa

SEQ ID NO: 126 - RNA, 21 nt, synthetic construct
  source 1..21: mol_type = other RNA; note = Description of Artificial Sequence: Synthetic oligonucleotide
caagatggctttgaactcaga

SEQ ID NO: 127 - RNA, 21 nt, synthetic construct
  source 1..21: mol_type = other RNA; note = Description of Artificial Sequence: Synthetic oligonucleotide
gacgtggtagtcacttgtaaa

SEQ ID NO: 128 - RNA, 21 nt, synthetic construct
  source 1..21: mol_type = other RNA; note = Description of Artificial Sequence: Synthetic oligonucleotide
gttatgtttctacacattgca

SEQ ID NO: 129 - RNA, 21 nt, synthetic construct
  source 1..21: mol_type = other RNA; note = Description of Artificial Sequence: Synthetic oligonucleotide
tttgcaagaatgaaatgaata

SEQ ID NO: 130 - RNA, 21 nt, synthetic construct
  source 1..21: mol_type = other RNA; note = Description of Artificial Sequence: Synthetic oligonucleotide
aggacttaaccttgaaatgga

SEQ ID NO: 131 - RNA, 21 nt, synthetic construct
  source 1..21: mol_type = other RNA; note = Description of Artificial Sequence: Synthetic oligonucleotide
tgtgaaaatgaatatcatgca

SEQ ID NO: 132 - RNA, 21 nt, synthetic construct
  source 1..21: mol_type = other RNA; note = Description of Artificial Sequence: Synthetic oligonucleotide
agtgatgcctgttcttcaaaa

SEQ ID NO: 133 - RNA, 21 nt, synthetic construct
  source 1..21: mol_type = other RNA; note = Description of Artificial Sequence: Synthetic oligonucleotide
ttcttcaaaagcagtggttta

SEQ ID NO: 134 - RNA, 21 nt, synthetic construct
  source 1..21: mol_type = other RNA; note = Description of Artificial Sequence: Synthetic oligonucleotide
tcaaaagcagtggtttcttta

SEQ ID NO: 135 - RNA, 21 nt, synthetic construct
  source 1..21: mol_type = other RNA; note = Description of Artificial Sequence: Synthetic oligonucleotide
caaaagcagtggtttctttaa

SEQ ID NO: 136 - RNA, 21 nt, synthetic construct
  source 1..21: mol_type = other RNA; note = Description of Artificial Sequence: Synthetic oligonucleotide
ggtttctttacgctgtataga

SEQ ID NO: 137 - RNA, 21 nt, synthetic construct
  source 1..21: mol_type = other RNA; note = Description of Artificial Sequence: Synthetic oligonucleotide
atacctatcattactcgatga

SEQ ID NO: 138 - RNA, 21 nt, synthetic construct
  source 1..21: mol_type = other RNA; note = Description of Artificial Sequence: Synthetic oligonucleotide
atcattactcgatgctgttga

SEQ ID NO: 139 - RNA, 21 nt, synthetic construct
  source 1..21: mol_type = other RNA; note = Description of Artificial Sequence: Synthetic oligonucleotide
aaaaagtgatttctcatccaa

SEQ ID NO: 140 - RNA, 21 nt, synthetic construct
  source 1..21: mol_type = other RNA; note = Description of Artificial Sequence: Synthetic oligonucleotide
actccaagaccaagaacaata

SEQ ID NO: 141 - RNA, 21 nt, synthetic construct
  source 1..21: mol_type = other RNA; note = Description of Artificial Sequence: Synthetic oligonucleotide
ccaagaccaagaacaatgaca

SEQ ID NO: 142 - RNA, 21 nt, synthetic construct
  source 1..21: mol_type = other RNA; note = Description of Artificial Sequence: Synthetic oligonucleotide
aagaccaagaacaatgacata

SEQ ID NO: 143 - RNA, 21 nt, synthetic construct
  source 1..21: mol_type = other RNA; note = Description of Artificial Sequence: Synthetic oligonucleotide
ctggatttatcgacaaatgaa

SEQ ID NO: 144 - RNA, 21 nt, synthetic construct
  source 1..21: mol_type = other RNA; note = Description of Artificial Sequence: Synthetic oligonucleotide
ttcagaggtcacttcatttta

SEQ ID NO: 145 - RNA, 21 nt, synthetic construct
  source 1..21: mol_type = other RNA; note = Description of Artificial Sequence: Synthetic oligonucleotide
agaggtcacttcatttttata

SEQ ID NO: 146 - RNA, 21 nt, synthetic construct
  source 1..21: mol_type = other RNA; note = Description of Artificial Sequence: Synthetic oligonucleotide
gaggtcacttcatttttatta

SEQ ID NO: 147 - RNA, 21 nt, synthetic construct
  source 1..21: mol_type = other RNA; note = Description of Artificial Sequence: Synthetic oligonucleotide
ggaacagaaacatttttgtta

SEQ ID NO: 148 - RNA, 21 nt, synthetic construct
  source 1..21: mol_type = other RNA; note = Description of Artificial Sequence: Synthetic oligonucleotide
tgctagtcactggaaattgaa

SEQ ID NO: 149 - RNA, 21 nt, synthetic construct
  source 1..21: mol_type = other RNA; note = Description of Artificial Sequence: Synthetic oligonucleotide
ttatgtttctacacattgcta

SEQ ID NO: 150 - RNA, 21 nt, synthetic construct
  source 1..21: mol_type = other RNA; note = Description of Artificial Sequence: Synthetic oligonucleotide
cttttgatgtctccaagtaga

SEQ ID NO: 151 - RNA, 21 nt, synthetic construct
  source 1..21: mol_type = other RNA; note = Description of Artificial Sequence: Synthetic oligonucleotide
tgatgtctccaagtagtccaa

SEQ ID NO: 152 - RNA, 21 nt, synthetic construct
  source 1..21: mol_type = other RNA; note = Description of Artificial Sequence: Synthetic oligonucleotide
ttctataaatgaatgtgctga

SEQ ID NO: 153 - RNA, 21 nt, synthetic construct
  source 1..21: mol_type = other RNA; note = Description of Artificial Sequence: Synthetic oligonucleotide
agaatgaaatgaatgattcta

SEQ ID NO: 154 - RNA, 21 nt, synthetic construct
  source 1..21: mol_type = other RNA; note = Description of Artificial Sequence: Synthetic oligonucleotide
aatgaaatgaatgattctaca

SEQ ID NO: 155 - RNA, 21 nt, synthetic construct
  source 1..21: mol_type = other RNA; note = Description of Artificial Sequence: Synthetic oligonucleotide
ggacttaaccttgaaatggaa

SEQ ID NO: 156 - RNA, 21 nt, synthetic construct
  source 1..21: mol_type = other RNA; note = Description of Artificial Sequence: Synthetic oligonucleotide
gacttaaccttgaaatggaaa

SEQ ID NO: 157 - RNA, 21 nt, synthetic construct
  source 1..21: mol_type = other RNA; note = Description of Artificial Sequence: Synthetic oligonucleotide
agtcatgcaatcccatttgca

SEQ ID NO: 158 - RNA, 21 nt, synthetic construct
  source 1..21: mol_type = other RNA; note = Description of Artificial Sequence: Synthetic oligonucleotide
gtcatgcaatcccatttgcaa

SEQ ID NO: 159 - RNA, 21 nt, synthetic construct
  source 1..21: mol_type = other RNA; note = Description of Artificial Sequence: Synthetic oligonucleotide
gtgcacctcaaagactaagaa

SEQ ID NO: 160 - RNA, 21 nt, synthetic construct
  source 1..21: mol_type = other RNA; note = Description of Artificial Sequence: Synthetic oligonucleotide
tccaccagctttatgaaacta

SEQ ID NO: 161 - RNA, 21 nt, synthetic construct
  source 1..21: mol_type = other RNA; note = Description of Artificial Sequence: Synthetic oligonucleotide
agctttatgaaactgaacaca

SEQ ID NO: 162 - RNA, 21 nt, synthetic construct
  source 1..21: mol_type = other RNA; note = Description of Artificial Sequence: Synthetic oligonucleotide
atgaaactgaacacaagtgca

SEQ ID NO: 163 - RNA, 21 nt, synthetic construct
  source 1..21: mol_type = other RNA; note = Description of Artificial Sequence: Synthetic oligonucleotide
attgaacattccagataccta

SEQ ID NO: 164 - RNA, 21 nt, synthetic construct
  source 1..21: mol_type = other RNA; note = Description of Artificial Sequence: Synthetic oligonucleotide
aaaagcagtggtttctttaca

SEQ ID NO: 165 - RNA, 21 nt, synthetic construct
  source 1..21: mol_type = other RNA; note = Description of Artificial Sequence: Synthetic oligonucleotide
gtttctttacgctgtatagca

SEQ ID NO: 166 - RNA, 21 nt, synthetic construct
  source 1..21: mol_type = other RNA; note = Description of Artificial Sequence: Synthetic oligonucleotide
attactcgatgctgttgataa

SEQ ID NO: 167 - RNA, 21 nt, synthetic construct
  source 1..21: mol_type = other RNA; note = Description of Artificial Sequence: Synthetic oligonucleotide
gaccaagaacaatgacattga

SEQ ID NO: 168 - RNA, 21 nt, synthetic construct
  source 1..21: mol_type = other RNA; note = Description of Artificial Sequence: Synthetic oligonucleotide
accaagaacaatgacattgca

SEQ ID NO: 169 - RNA, 21 nt, synthetic construct
  source 1..21: mol_type = other RNA; note = Description of Artificial Sequence: Synthetic oligonucleotide
agcaagatggctttgaactca

SEQ ID NO: 170 - RNA, 21 nt, synthetic construct
  source 1..21: mol_type = other RNA; note = Description of Artificial Sequence: Synthetic oligonucleotide
cacggactggatttatcgaca

SEQ ID NO: 171 - RNA, 21 nt, synthetic construct
  source 1..21: mol_type = other RNA; note = Description of Artificial Sequence: Synthetic oligonucleotide
acggactggatttatcgacaa

SEQ ID NO: 172 - RNA, 21 nt, synthetic construct
  source 1..21: mol_type = other RNA; note = Description of Artificial Sequence: Synthetic oligonucleotide
tggatttatcgacaaatgaga

SEQ ID NO: 173 - RNA, 21 nt, synthetic construct
  source 1..21: mol_type = other RNA; note = Description of Artificial Sequence: Synthetic oligonucleotide
acgtggtagtcacttgtaaga

SEQ ID NO: 174 - RNA, 21 nt, synthetic construct
  source 1..21: mol_type = other RNA; note = Description of Artificial Sequence: Synthetic oligonucleotide
tagtcactggaaattgaggta

SEQ ID NO: 175 - RNA, 21 nt, synthetic construct
  source 1..21: mol_type = other RNA; note = Description of Artificial Sequence: Synthetic oligonucleotide
aaatcaaggatgctcagttta

SEQ ID NO: 176 - RNA, 21 nt, synthetic construct
  source 1..21: mol_type = other RNA; note = Description of Artificial Sequence: Synthetic oligonucleotide
tctataaatgaatgtgctgaa

SEQ ID NO: 177 - RNA, 21 nt, synthetic construct
  source 1..21: mol_type = other RNA; note = Description of Artificial Sequence: Synthetic oligonucleotide
tataaatgaatgtgctgaaga

SEQ ID NO: 178 - RNA, 21 nt, synthetic construct
  source 1..21: mol_type = other RNA; note = Description of Artificial Sequence: Synthetic oligonucleotide
tttgttttggactctctgtga

SEQ ID NO: 179 - RNA, 21 nt, synthetic construct
  source 1..21: mol_type = other RNA; note = Description of Artificial Sequence: Synthetic oligonucleotide
ggctggtttgcaagaatgaaa

SEQ ID NO: 180 - RNA, 21 nt, synthetic construct
  source 1..21: mol_type = other RNA; note = Description of Artificial Sequence: Synthetic oligonucleotide
agctaggacttaaccttgaaa

SEQ ID NO: 181 - RNA, 21 nt, synthetic construct
  source 1..21: mol_type = other RNA; note = Description of Artificial Sequence: Synthetic oligonucleotide
tcccatttgcaggatctgtca

SEQ ID NO: 182 - RNA, 21 nt, synthetic construct
  source 1..21: mol_type = other RNA; note = Description of Artificial Sequence: Synthetic oligonucleotide
aaagttcaattgtgaaaatga

SEQ ID NO: 183 - RNA, 21 nt, synthetic construct
  source 1..21: mol_type = other RNA; note = Description of Artificial Sequence: Synthetic oligonucleotide
tgcacctcaaagactaagaaa

SEQ ID NO: 184 - RNA, 21 nt, synthetic construct
  source 1..21: mol_type = other RNA; note = Description of Artificial Sequence: Synthetic oligonucleotide
aaagactaagaaagcactgta

SEQ ID NO: 185 - RNA, 21 nt, synthetic construct
  source 1..21: mol_type = other RNA; note = Description of Artificial Sequence: Synthetic oligonucleotide
caggtgtactcatctcagaga

SEQ ID NO: 186 - RNA, 21 nt, synthetic construct
  source 1..21: mol_type = other RNA; note = Description of Artificial Sequence: Synthetic oligonucleotide
actctagccaaggaatagtga

SEQ ID NO: 187 - RNA, 21 nt, synthetic construct
  source 1..21: mol_type = other RNA; note = Description of Artificial Sequence: Synthetic oligonucleotide
cagtgatgcctgttcttcaaa

SEQ ID NO: 188 - RNA, 21 nt, synthetic construct
  source 1..21: mol_type = other RNA; note = Description of Artificial Sequence: Synthetic oligonucleotide
aaagcagtggtttctttacga

SEQ ID NO: 189 - RNA, 21 nt, synthetic construct
  source 1..21: mol_type = other RNA; note = Description of Artificial Sequence: Synthetic oligonucleotide
gcagtggtttctttacgctga

SEQ ID NO: 190 - RNA, 21 nt, synthetic construct
  source 1..21: mol_type = other RNA; note = Description of Artificial Sequence: Synthetic oligonucleotide
cagtggtttctttacgctgta

SEQ ID NO: 191 - RNA, 21 nt, synthetic construct
  source 1..21: mol_type = other RNA; note = Description of Artificial Sequence: Synthetic oligonucleotide
cctatcattactcgatgctga

SEQ ID NO: 192 - RNA, 21 nt, synthetic construct
  source 1..21: mol_type = other RNA; note = Description of Artificial Sequence: Synthetic oligonucleotide
atgactccaagaccaagaaca

SEQ ID NO: 193 - RNA, 21 nt, synthetic construct
  source 1..21: mol_type = other RNA; note = Description of Artificial Sequence: Synthetic oligonucleotide
tccaagaccaagaacaatgaa

SEQ ID NO: 194 - RNA, 21 nt, synthetic construct
  source 1..21: mol_type = other RNA; note = Description of Artificial Sequence: Synthetic oligonucleotide
ttcacggactggatttatcga

SEQ ID NO: 195 - RNA, 21 nt, synthetic construct
  source 1..21: mol_type = other RNA; note = Description of Artificial Sequence: Synthetic oligonucleotide
tgattcagaggtcacttcata

SEQ ID NO: 196 - RNA, 21 nt, synthetic construct
  source 1..21: mol_type = other RNA; note = Description of Artificial Sequence: Synthetic oligonucleotide
gattcagaggtcacttcatta

SEQ ID NO: 197 - RNA, 21 nt, synthetic construct
  source 1..21: mol_type = other RNA; note = Description of Artificial Sequence: Synthetic oligonucleotide
attcagaggtcacttcattta

SEQ ID NO: 198 - RNA, 21 nt, synthetic construct
  source 1..21: mol_type = other RNA; note = Description of Artificial Sequence: Synthetic oligonucleotide
agtcactggaaattgaggtca

SEQ ID NO: 199 - RNA, 21 nt, synthetic construct
  source 1..21: mol_type = other RNA; note = Description of Artificial Sequence: Synthetic oligonucleotide
gtttctacacattgctaccta

SEQ ID NO: 200 - RNA, 21 nt, synthetic construct
  source 1..21: mol_type = other RNA; note = Description of Artificial Sequence: Synthetic oligonucleotide
tttctacacattgctacctca

SEQ ID NO: 201 - RNA, 21 nt, synthetic construct
  source 1..21: mol_type = other RNA; note = Description of Artificial Sequence: Synthetic oligonucleotide
ttgatgtctccaagtagtcca

SEQ ID NO: 202 - RNA, 21 nt, synthetic construct
  source 1..21: mol_type = other RNA; note = Description of Artificial Sequence: Synthetic oligonucleotide
gttctataaatgaatgtgcta

SEQ ID NO: 203 - RNA, 21 nt, synthetic construct
  source 1..21: mol_type = other RNA; note = Description of Artificial Sequence: Synthetic oligonucleotide
tgttttggactctctgtggta

SEQ ID NO: 204 - RNA, 21 nt, synthetic construct
  source 1..21: mol_type = other RNA; note = Description of Artificial Sequence: Synthetic oligonucleotide
taaccatgagcactactctaa

SEQ ID NO: 205 - RNA, 21 nt, synthetic construct
  source 1..21: mol_type = other RNA; note = Description of Artificial Sequence: Synthetic oligonucleotide
gcaggctggtttgcaagaata

SEQ ID NO: 206 - RNA, 21 nt, synthetic construct
  source 1..21: mol_type = other RNA; note = Description of Artificial Sequence: Synthetic oligonucleotide
caagaatgaaatgaatgatta

SEQ ID NO: 207 - RNA, 21 nt, synthetic construct
  source 1..21: mol_type = other RNA; note = Description of Artificial Sequence: Synthetic oligonucleotide
aagactaagaaagcactgtga

SEQ ID NO: 208 - RNA, 21 nt, synthetic construct
  source 1..21: mol_type = other RNA; note = Description of Artificial Sequence: Synthetic oligonucleotide
cttcaggtgtactcatctcaa

SEQ ID NO: 209 - RNA, 21 nt, synthetic construct
  source 1..21: mol_type = other RNA; note = Description of Artificial Sequence: Synthetic oligonucleotide
ttcaggtgtactcatctcaga

SEQ ID NO: 210 - RNA, 21 nt, synthetic construct
  source 1..21: mol_type = other RNA; note = Description of Artificial Sequence: Synthetic oligonucleotide
ccaccagctttatgaaactga

SEQ ID NO: 211 - RNA, 21 nt, synthetic construct
  source 1..21: mol_type = other RNA; note = Description of Artificial Sequence: Synthetic oligonucleotide
aagcagtggtttctttacgca

SEQ ID NO: 212 - RNA, 21 nt, synthetic construct
  source 1..21: mol_type = other RNA; note = Description of Artificial Sequence: Synthetic oligonucleotide
agcagtggtttctttacgcta

SEQ ID NO: 213 - RNA, 21 nt, synthetic construct
  source 1..21: mol_type = other RNA; note = Description of Artificial Sequence: Synthetic oligonucleotide
caagaacaatgacattgcgca

SEQ ID NO: 214 - RNA, 21 nt, synthetic construct
  source 1..21: mol_type = other RNA; note = Description of Artificial Sequence: Synthetic oligonucleotide
cggactggatttatcgacaaa

SEQ ID NO: 215 - RNA, 21 nt, synthetic construct
  source 1..21: mol_type = other RNA; note = Description of Artificial Sequence: Synthetic oligonucleotide
ggatttatcgacaaatgagga

SEQ ID NO: 216 - RNA, 21 nt, synthetic construct
  source 1..21: mol_type = other RNA; note = Description of Artificial Sequence: Synthetic oligonucleotide
tgacgtggtagtcacttgtaa

SEQ ID NO: 217 - RNA, 21 nt, synthetic construct
  source 1..21: mol_type = other RNA; note = Description of Artificial Sequence: Synthetic oligonucleotide
cgttctataaatgaatgtgca

SEQ ID NO: 218 - RNA, 21 nt, synthetic construct
  source 1..21: mol_type = other RNA; note = Description of Artificial Sequence: Synthetic oligonucleotide
agaaagatgtgttttgtttta

SEQ ID NO: 219 - RNA, 21 nt, synthetic construct
  source 1..21: mol_type = other RNA; note = Description of Artificial Sequence: Synthetic oligonucleotide
gaaagatgtgttttgttttga

SEQ ID NO: 220 - RNA, 21 nt, synthetic construct
  source 1..21: mol_type = other RNA; note = Description of Artificial Sequence: Synthetic oligonucleotide
agatgtgttttgttttggaca

SEQ ID NO: 221 - RNA, 21 nt, synthetic construct
  source 1..21: mol_type = other RNA; note = Description of Artificial Sequence: Synthetic oligonucleotide
ttgcaagaatgaaatgaatga

SEQ ID NO: 222 - RNA, 21 nt, synthetic construct
  source 1..21: mol_type = other RNA; note = Description of Artificial Sequence: Synthetic oligonucleotide
tgcaagaatgaaatgaatgaa

SEQ ID NO: 223 - RNA, 21 nt, synthetic construct
  source 1..21: mol_type = other RNA; note = Description of Artificial Sequence: Synthetic oligonucleotide
gcaagaatgaaatgaatgata

SEQ ID NO: 224 - RNA, 21 nt, synthetic construct
  source 1..21: mol_type = other RNA; note = Description of Artificial Sequence: Synthetic oligonucleotide
aagtcatgcaatcccatttga

SEQ ID NO: 225 - RNA, 21 nt, synthetic construct
  source 1..21: mol_type = other RNA; note = Description of Artificial Sequence: Synthetic oligonucleotide
atcccatttgcaggatctgta

SEQ ID NO: 226 - RNA, 21 nt, synthetic construct
  source 1..21: mol_type = other RNA; note = Description of Artificial Sequence: Synthetic oligonucleotide
tctgtagagagcagcattcca

SEQ ID NO: 227 - RNA, 21 nt, synthetic construct
  source 1..21: mol_type = other RNA; note = Description of Artificial Sequence: Synthetic oligonucleotide
taatggtgaaaacgtcttcca

SEQ ID NO: 228 - RNA, 21 nt, synthetic construct
  source 1..21: mol_type = other RNA; note = Description of Artificial Sequence: Synthetic oligonucleotide
gtgaaaatgaatatcatgcaa

SEQ ID NO: 229 - RNA, 21 nt, synthetic construct
  source 1..21: mol_type = other RNA; note = Description of Artificial Sequence: Synthetic oligonucleotide
tgaaaatgaatatcatgcaaa

SEQ ID NO: 230 - RNA, 21 nt, synthetic construct
  source 1..21: mol_type = other RNA; note = Description of Artificial Sequence: Synthetic oligonucleotide
ccttcaggtgtactcatctca

SEQ ID NO: 231 - RNA, 21 nt, synthetic construct
  source 1..21: mol_type = other RNA; note = Description of Artificial Sequence: Synthetic oligonucleotide
cgactggaacgagaactacga

SEQ ID NO: 232 - RNA, 21 nt, synthetic construct
  source 1..21: mol_type = other RNA; note = Description of Artificial Sequence: Synthetic oligonucleotide
gggacatgggctataagaata

SEQ ID NO: 233 - RNA, 21 nt, synthetic construct
  source 1..21: mol_type = other RNA; note = Description of Artificial Sequence: Synthetic oligonucleotide
ttttactctagccaaggaata

SEQ ID NO: 234 - RNA, 21 nt, synthetic construct
  source 1..21: mol_type = other RNA; note = Description of Artificial Sequence: Synthetic oligonucleotide
tactctagccaaggaatagta

SEQ ID NO: 235 - RNA, 21 nt, synthetic construct
  source 1..21: mol_type = other RNA; note = Description of Artificial Sequence: Synthetic oligonucleotide
tatgaaactgaacacaagtga

SEQ ID NO: 236 - RNA, 21 nt, synthetic construct
  source 1..21: mol_type = other RNA; note = Description of Artificial Sequence: Synthetic oligonucleotide
tacctatcattactcgatgca

SEQ ID NO: 237 - RNA, 21 nt, synthetic construct
  source 1..21: mol_type = other RNA; note = Description of Artificial Sequence: Synthetic oligonucleotide
attcacggactggatttatca

SEQ ID NO: 238 - RNA, 21 nt, synthetic construct
  source 1..21: mol_type = other RNA; note = Description of Artificial Sequence: Synthetic oligonucleotide
tcacggactggatttatcgaa

SEQ ID NO: 239 - RNA, 21 nt, synthetic construct
  source 1..21: mol_type = other RNA; note = Description of Artificial Sequence: Synthetic oligonucleotide
atgaaaaccatggataccaaa

SEQ ID NO: 240 - RNA, 21 nt, synthetic construct
  source 1..21: mol_type = other RNA; note = Description of Artificial Sequence: Synthetic oligonucleotide
cgtggtagtcacttgtaagga

SEQ ID NO: 241 - RNA, 21 nt, synthetic construct
  source 1..21: mol_type = other RNA; note = Description of Artificial Sequence: Synthetic oligonucleotide
gcgaagaagagaaagatgtga

SEQ ID NO: 242 - RNA, 21 nt, synthetic construct
  source 1..21: mol_type = other RNA; note = Description of Artificial Sequence: Synthetic oligonucleotide
gaagaagagaaagatgtgtta

SEQ ID NO: 243 - RNA, 21 nt, synthetic construct
  source 1..21: mol_type = other RNA; note = Description of Artificial Sequence: Synthetic oligonucleotide
aagaagagaaagatgtgttta

SEQ ID NO: 244 - RNA, 21 nt, synthetic construct
  source 1..21: mol_type = other RNA; note = Description of Artificial Sequence: Synthetic oligonucleotide
agaagagaaagatgtgtttta

SEQ ID NO: 245 - RNA, 21 nt, synthetic construct
  source 1..21: mol_type = other RNA; note = Description of Artificial Sequence: Synthetic oligonucleotide
ataaccatgagcactactcta

SEQ ID NO: 246 - RNA, 21 nt, synthetic construct
  source 1..21: mol_type = other RNA; note = Description of Artificial Sequence: Synthetic oligonucleotide
caggctggtttgcaagaatga

SEQ ID NO: 247 - RNA, 21 nt, synthetic construct
  source 1..21: mol_type = other RNA; note = Description of Artificial Sequence: Synthetic oligonucleotide
tcatgcaatcccatttgcaga

SEQ ID NO: 248 - RNA, 21 nt, synthetic construct
  source 1..21: mol_type = other RNA; note = Description of Artificial Sequence: Synthetic oligonucleotide
cccatttgcaggatctgtcta

SEQ ID NO: 249 - RNA, 21 nt, synthetic construct
  source 1..21: mol_type = other RNA; note = Description of Artificial Sequence: Synthetic oligonucleotide
ctcatctcagaggaagtccta

SEQ ID NO: 250 - RNA, 21 nt, synthetic construct
  source 1..21: mol_type = other RNA; note = Description of Artificial Sequence: Synthetic oligonucleotide
gacgactggaacgagaactaa

SEQ ID NO: 251 - RNA, 21 nt, synthetic construct
  source 1..21: mol_type = other RNA; note = Description of Artificial Sequence: Synthetic oligonucleotide
ctagccaaggaatagtggata

SEQ ID NO: 252 - RNA, 21 nt, synthetic construct
  source 1..21: mol_type = other RNA; note = Description of Artificial Sequence: Synthetic oligonucleotide
aaactgtaccacagtgatgca

SEQ ID NO: 253 - RNA, 21 nt, synthetic construct
  source 1..21: mol_type = other RNA; note = Description of Artificial Sequence: Synthetic oligonucleotide
cacagtgatgcctgttcttca

SEQ ID NO: 254 - RNA, 21 nt, synthetic construct
  source 1..21: mol_type = other RNA; note = Description of Artificial Sequence: Synthetic oligonucleotide
aacaatgacattgcgctgata

SEQ ID NO: 255 - RNA, 21 nt, synthetic construct
  source 1..21: mol_type = other RNA; note = Description of Artificial Sequence: Synthetic oligonucleotide
caatgacattgcgctgatgaa

SEQ ID NO: 256 - RNA, 21 nt, synthetic construct
  source 1..21: mol_type = other RNA; note = Description of Artificial Sequence: Synthetic oligonucleotide
aaagatgtgttttgttttgga

SEQ ID NO: 257 - RNA, 21 nt, synthetic construct
  source 1..21: mol_type = other RNA; note = Description of Artificial Sequence: Synthetic oligonucleotide
tgccaagtgccataaccatga

SEQ ID NO: 258 - RNA, 21 nt, synthetic construct
  source 1..21: mol_type = other RNA; note = Description of Artificial Sequence: Synthetic oligonucleotide
tgtgcacctcaaagactaaga

SEQ ID NO: 259 - RNA, 21 nt, synthetic construct
  source 1..21: mol_type = other RNA; note = Description of Artificial Sequence: Synthetic oligonucleotide
agactaagaaagcactgtgca

SEQ ID NO: 260 - RNA, 21 nt, synthetic construct
  source 1..21: mol_type = other RNA; note = Description of Artificial Sequence: Synthetic oligonucleotide
aggtgtactcatctcagagga

SEQ ID NO: 261 - RNA, 21 nt, synthetic construct
  source 1..21: mol_type = other RNA; note = Description of Artificial Sequence: Synthetic oligonucleotide
ccacagtgatgcctgttctta

SEQ ID NO: 262 - RNA, 21 nt, synthetic construct
  source 1..21: mol_type = other RNA; note = Description of Artificial Sequence: Synthetic oligonucleotide
acagtgatgcctgttcttcaa

SEQ ID NO: 263 - RNA, 21 nt, synthetic construct
  source 1..21: mol_type = other RNA; note = Description of Artificial Sequence: Synthetic oligonucleotide
tgttcttcaaaagcagtggta

SEQ ID NO: 264 - RNA, 21 nt, synthetic construct
  source 1..21: mol_type = other RNA; note = Description of Artificial Sequence: Synthetic oligonucleotide
agaacaatgacattgcgctga

SEQ ID NO: 265 - RNA, 21 nt, synthetic construct
  source 1..21: mol_type = other RNA; note = Description of Artificial Sequence: Synthetic oligonucleotide
aagatggctttgaactcagga

SEQ ID NO: 266 - RNA, 21 nt, synthetic construct
  source 1..21: mol_type = other RNA; note = Description of Artificial Sequence: Synthetic oligonucleotide
gatggctttgaactcagggta

SEQ ID NO: 267 - RNA, 21 nt, synthetic construct
  source 1..21: mol_type = other RNA; note = Description of Artificial Sequence: Synthetic oligonucleotide
gcactctctgccattctgtga

SEQ ID NO: 268 - RNA, 21 nt, synthetic construct
  source 1..21: mol_type = other RNA; note = Description of Artificial Sequence: Synthetic oligonucleotide
ggtgacgtggtagtcacttga

SEQ ID NO: 269 - RNA, 21 nt, synthetic construct
  source 1..21: mol_type = other RNA; note = Description of Artificial Sequence: Synthetic oligonucleotide
gtgacgtggtagtcacttgta

SEQ ID NO: 270 - RNA, 21 nt, synthetic construct
  source 1..21: mol_type = other RNA; note = Description of Artificial Sequence: Synthetic oligonucleotide
ctagtcactggaaattgagga

SEQ ID NO: 271 - RNA, 21 nt, synthetic construct
  source 1..21: mol_type = other RNA; note = Description of Artificial Sequence: Synthetic oligonucleotide
actggaaattgaggtccatga

SEQ ID NO: 272 - RNA, 21 nt, synthetic construct
  source 1..21: mol_type = other RNA; note = Description of Artificial Sequence: Synthetic oligonucleotide
gaagagaaagatgtgttttga

SEQ ID NO: 273 - RNA, 21 nt, synthetic construct
  source 1..21: mol_type = other RNA; note = Description of Artificial Sequence: Synthetic oligonucleotide
gagaaagatgtgttttgttta

SEQ ID NO: 274 - RNA, 21 nt, synthetic construct
  source 1..21: mol_type = other RNA; note = Description of Artificial Sequence: Synthetic oligonucleotide
aagatgtgttttgttttggaa

SEQ ID NO: 275 - RNA, 21 nt, synthetic construct
  source 1..21: mol_type = other RNA; note = Description of Artificial Sequence: Synthetic oligonucleotide
ttgttttggactctctgtgga

SEQ ID NO: 276 - RNA, 21 nt, synthetic construct
  source 1..21: mol_type = other RNA; note = Description of Artificial Sequence: Synthetic oligonucleotide
tgtactcatctcagaggaaga

SEQ ID NO: 277 - RNA, 21 nt, synthetic construct
  source 1..21: mol_type = other RNA; note = Description of Artificial Sequence: Synthetic oligonucleotide
ccaagaacaatgacattgcga

SEQ ID NO: 278 - RNA, 21 nt, synthetic construct
  source 1..21: mol_type = other RNA; note = Description of Artificial Sequence: Synthetic oligonucleotide
gaacaatgacattgcgctgaa

SEQ ID NO: 279 - RNA, 21 nt, synthetic construct
  source 1..21: mol_type = other RNA; note = Description of Artificial Sequence: Synthetic oligonucleotide
tgacattgcgctgatgaagca

SEQ ID NO: 280 - RNA, 21 nt, synthetic construct
  source 1..21: mol_type = other RNA; note = Description of Artificial Sequence: Synthetic oligonucleotide
ggagaaagggaagacctcaga

SEQ ID NO: 281 - RNA, 21 nt, synthetic construct
  source 1..21: mol_type = other RNA; note = Description of Artificial Sequence: Synthetic oligonucleotide
ttggcactctctgccattcta

SEQ ID NO: 282 - RNA, 21 nt, synthetic construct
  source 1..21: mol_type = other RNA; note = Description of Artificial Sequence: Synthetic oligonucleotide
cgaagaagagaaagatgtgta

SEQ ID NO: 283 - RNA, 21 nt, synthetic construct
  source 1..21: mol_type = other RNA; note = Description of Artificial Sequence: Synthetic oligonucleotide
aagagaaagatgtgttttgta

SEQ ID NO: 284 - RNA, 21 nt, synthetic construct
  source 1..21: mol_type = other RNA; note = Description of Artificial Sequence: Synthetic oligonucleotide
aggctggtttgcaagaatgaa

SEQ ID NO: 285 - RNA, 21 nt, synthetic construct
  source 1..21: mol_type = other RNA; note = Description of Artificial Sequence: Synthetic oligonucleotide
tgcaatcccatttgcaggata

SEQ ID NO: 286 - RNA, 21 nt, synthetic construct
  source 1..21: mol_type = other RNA; note = Description of Artificial Sequence: Synthetic oligonucleotide
gcaatcccatttgcaggatca

SEQ ID NO: 287 - RNA, 21 nt, synthetic construct
  source 1..21: mol_type = other RNA; note = Description of Artificial Sequence: Synthetic oligonucleotide
catgcctctgtagagagcaga

SEQ ID NO: 288 - RNA, 21 nt, synthetic construct
  source 1..21: mol_type = other RNA; note = Description of Artificial Sequence: Synthetic oligonucleotide
tctgggatagagtgcgactca

SEQ ID NO: 289 - RNA, 21 nt, synthetic construct
  source 1..21: mol_type = other RNA; note = Description of Artificial Sequence: Synthetic oligonucleotide
actcatctcagaggaagtcca

SEQ ID NO: 290 - RNA, 21 nt, synthetic construct
  source 1..21: mol_type = other RNA; note = Description of Artificial Sequence: Synthetic oligonucleotide
acgactggaacgagaactaca

SEQ ID NO: 291 - RNA, 21 nt, synthetic construct
  source 1..21: mol_type = other RNA; note = Description of Artificial Sequence: Synthetic oligonucleotide
tttttactctagccaaggaaa

SEQ ID NO: 292 - RNA, 21 nt, synthetic construct
  source 1..21: mol_type = other RNA; note = Description of Artificial Sequence: Synthetic oligonucleotide
ttactctagccaaggaataga

SEQ ID NO: 293 - RNA, 21 nt, synthetic construct
  source 1..21: mol_type = other RNA; note = Description of Artificial Sequence: Synthetic oligonucleotide
actgtaccacagtgatgccta

SEQ ID NO: 294 - RNA, 21 nt, synthetic construct
  source 1..21: mol_type = other RNA; note = Description of Artificial Sequence: Synthetic oligonucleotide
accacagtgatgcctgttcta

SEQ ID NO: 295 - RNA, 21 nt, synthetic construct
  source 1..21: mol_type = other RNA; note = Description of Artificial Sequence: Synthetic oligonucleotide
acaatgacattgcgctgatga

SEQ ID NO: 296 - RNA, 21 nt, synthetic construct
  source 1..21: mol_type = other RNA; note = Description of Artificial Sequence: Synthetic oligonucleotide
atgacattgcgctgatgaaga

SEQ ID NO: 297 - RNA, 21 nt, synthetic construct
  source 1..21: mol_type = other RNA; note = Description of Artificial Sequence: Synthetic oligonucleotide
ccaggagtgtacgggaatgta

SEQ ID NO: 298 - RNA, 21 nt, synthetic construct
  source 1..21: mol_type = other RNA; note = Description of Artificial Sequence: Synthetic oligonucleotide
tattcacggactggatttata

SEQ ID NO: 299 - RNA, 21 nt, synthetic construct
  source 1..21: mol_type = other RNA; note = Description of Artificial Sequence: Synthetic oligonucleotide
gatttatcgacaaatgaggga

SEQ ID NO: 300 - RNA, 21 nt, synthetic construct
  source 1..21: mol_type = other RNA; note = Description of Artificial Sequence: Synthetic oligonucleotide
agagatgattcagaggtcaca

SEQ ID NO: 301 - RNA, 21 nt, synthetic construct
  source 1..21: mol_type = other RNA; note = Description of Artificial Sequence: Synthetic oligonucleotide
agagaaagatgtgttttgtta

SEQ ID NO: 302 - RNA, 21 nt, synthetic construct
  source 1..21: mol_type = other RNA; note = Description of Artificial Sequence: Synthetic oligonucleotide
caagtgccataaccatgagca

SEQ ID NO: 303 - RNA, 21 nt, synthetic construct
  source 1..21: mol_type = other RNA; note = Description of Artificial Sequence: Synthetic oligonucleotide
cataaccatgagcactactca

SEQ ID NO: 304 - RNA, 21 nt, synthetic construct
  source 1..21: mol_type = other RNA; note = Description of Artificial Sequence: Synthetic oligonucleotide
catttgcaggatctgtctgta

SEQ ID NO: 305 - RNA, 21 nt, synthetic construct
  source 1..21: mol_type = other RNA; note = Description of Artificial Sequence: Synthetic oligonucleotide
tcatctcagaggaagtcctga

SEQ ID NO: 306 - RNA, 21 nt, synthetic construct
  source 1..21: mol_type = other RNA; note = Description of Artificial Sequence: Synthetic oligonucleotide
caggagtgtacgggaatgtga

SEQ ID NO: 307 - RNA, 21 nt, synthetic construct
  source 1..21: mol_type = other RNA; note = Description of Artificial Sequence: Synthetic oligonucleotide
tctggctttggcactctctga

SEQ ID NO: 308 - RNA, 21 nt, synthetic construct
  source 1..21: mol_type = other RNA; note = Description of Artificial Sequence: Synthetic oligonucleotide
tggcactctctgccattctga

SEQ ID NO: 309 - RNA, 21 nt, synthetic construct
  source 1..21: mol_type = other RNA; note = Description of Artificial Sequence: Synthetic oligonucleotide
ggcactctctgccattctgta

SEQ ID NO: 310 - RNA, 21 nt, synthetic construct
  source 1..21: mol_type = other RNA; note = Description of Artificial Sequence: Synthetic oligonucleotide
accatggataccaaccggaaa

SEQ ID NO: 311 - RNA, 21 nt, synthetic construct
  source 1..21: mol_type = other RNA; note = Description of Artificial Sequence: Synthetic oligonucleotide
ccatggataccaaccggaaaa

SEQ ID NO: 312 - RNA, 21 nt, synthetic construct
  source 1..21: mol_type = other RNA; note = Description of Artificial Sequence: Synthetic oligonucleotide
gggaaatcaaggatgctcaga

SEQ ID NO: 313 - RNA, 21 nt, synthetic construct
  source 1..21: mol_type = other RNA; note = Description of Artificial Sequence: Synthetic oligonucleotide
ccaagtgccataaccatgaga

SEQ ID NO: 314 - RNA, 21 nt, synthetic construct
  source 1..21: mol_type = other RNA; note = Description of Artificial Sequence: Synthetic oligonucleotide
catgcaatcccatttgcagga

SEQ ID NO: 315 - RNA, 21 nt, synthetic construct
  source 1..21: mol_type = other RNA; note = Description of Artificial Sequence: Synthetic oligonucleotide
ccatttgcaggatctgtctga

SEQ ID NO: 316 - RNA, 21 nt, synthetic construct
  source 1..21: mol_type = other RNA; note = Description of Artificial Sequence: Synthetic oligonucleotide
tgcaggatctgtctgtgcaca

SEQ ID NO: 317 - RNA, 23 nt, synthetic construct
  source 1..23: mol_type = other RNA; note = Description of Artificial Sequence: Synthetic oligonucleotide
tgtttcaaagagttaaatgaagg

SEQ ID NO: 318 - RNA, 23 nt, synthetic construct
  source 1..23: mol_type = other RNA; note = Description of Artificial Sequence: Synthetic oligonucleotide
taataaagaaggaagacgttttc

SEQ ID NO: 319 - RNA, 23 nt, synthetic construct
  source 1..23: mol_type = other RNA; note = Description of Artificial Sequence: Synthetic oligonucleotide
tcaataaagaaggaagacgtttt

SEQ ID NO: 320 - RNA, 23 nt, synthetic construct
  source 1..23: mol_type = other RNA; note = Description of Artificial Sequence: Synthetic oligonucleotide
tgaaggaagacgttttcaccatt

SEQ ID NO: 321 - RNA, 23 nt, synthetic construct
  source 1..23: mol_type = other RNA; note = Description of Artificial Sequence: Synthetic oligonucleotide
ttatacagcgtaaagaaaccact

SEQ ID NO: 322 - RNA, 23 nt, synthetic construct
  source 1..23: mol_type = other RNA; note = Description of Artificial Sequence: Synthetic oligonucleotide
tgtaatgataggtatctggaatg

SEQ ID NO: 323 - RNA, 23 nt, synthetic construct
  source 1..23: mol_type = other RNA; note = Description of Artificial Sequence: Synthetic oligonucleotide
tagtaatgataggtatctggaat

SEQ ID NO: 324 - RNA, 23 nt, synthetic construct
  source 1..23: mol_type = other RNA; note = Description of Artificial Sequence: Synthetic oligonucleotide
tcgagtaatgataggtatctgga

SEQ ID NO: 325 - RNA, 23 nt, synthetic construct
  source 1..23: mol_type = other RNA; note = Description of Artificial Sequence: Synthetic oligonucleotide
tatcgagtaatgataggtatctg

SEQ ID NO: 326 - RNA, 23 nt, synthetic construct
  source 1..23: mol_type = other RNA; note = Description of Artificial Sequence: Synthetic oligonucleotide
ttgttaagaggtttttccacgca

SEQ ID NO: 327 - RNA, 23 nt, synthetic construct
  source 1..23: mol_type = other RNA; note = Description of Artificial Sequence: Synthetic oligonucleotide
taatttggatgagaaatcacttt

SEQ ID NO: 328 - RNA, 23 nt, synthetic construct
  source 1..23: mol_type = other RNA; note = Description of Artificial Sequence: Synthetic oligonucleotide
tgagtcataatttggatgagaaa

SEQ ID NO: 329 - RNA, 23 nt, synthetic construct
  source 1..23: mol_type = other RNA; note = Description of Artificial Sequence: Synthetic oligonucleotide
tcttggagtcataatttggatga

SEQ ID NO: 330 - RNA, 23 nt, synthetic construct
  source 1..23: mol_type = other RNA; note = Description of Artificial Sequence: Synthetic oligonucleotide
tcatttgtcgataaatccagtcc

SEQ ID NO: 331 - RNA, 23 nt, synthetic construct
  source 1..23: mol_type = other RNA; note = Description of Artificial Sequence: Synthetic oligonucleotide
tgactacttggagacatcaaaag

SEQ ID NO: 332 - RNA, 23 nt, synthetic construct
  source 1..23: mol_type = other RNA; note = Description of Artificial Sequence: Synthetic oligonucleotide
taccttttaggatgtgtcttggg

SEQ ID NO: 333 - RNA, 23 nt, synthetic construct
  source 1..23: mol_type = other RNA; note = Description of Artificial Sequence: Synthetic oligonucleotide
tgaagacgttttcaccattacaa

SEQ ID NO: 334 - RNA, 23 nt, synthetic construct
  source 1..23: mol_type = other RNA; note = Description of Artificial Sequence: Synthetic oligonucleotide
taaagaaggaagacgttttcacc

SEQ ID NO: 335 - RNA, 23 nt, synthetic construct
  source 1..23: mol_type = other RNA; note = Description of Artificial Sequence: Synthetic oligonucleotide
ttaaagaaggaagacgttttcac

SEQ ID NO: 336 - RNA, 23 nt, synthetic construct
  source 1..23: mol_type = other RNA; note = Description of Artificial Sequence: Synthetic oligonucleotide
tcacaattgaactttacagttta

SEQ ID NO: 337 - RNA, 23 nt, synthetic construct
  source 1..23: mol_type = other RNA; note = Description of Artificial Sequence: Synthetic oligonucleotide
tacttcctctgagatgagtacac

SEQ ID NO: 338 - RNA, 23 nt, synthetic construct
  source 1..23: mol_type = other RNA; note = Description of Artificial Sequence: Synthetic oligonucleotide
ttatagatatcgacattgccggc

SEQ ID NO: 339 - RNA, 23 nt, synthetic construct
  source 1..23: mol_type = other RNA; note = Description of Artificial Sequence: Synthetic oligonucleotide
tttatagatatcgacattgccgg

SEQ ID NO: 340 - RNA, 23 nt, synthetic construct
  source 1..23: mol_type = other RNA; note = Description of Artificial Sequence: Synthetic oligonucleotide
ttttatagatatcgacattgccg

SEQ ID NO: 341 - RNA, 23 nt, synthetic construct
  source 1..23: mol_type = other RNA; note = Description of Artificial Sequence: Synthetic oligonucleotide
tttttatagatatcgacattgcc

SEQ ID NO: 342 - RNA, 23 nt, synthetic construct
  source 1..23: mol_type = other RNA; note = Description of Artificial Sequence: Synthetic oligonucleotide
tatacagcgtaaagaaaccactg

SEQ ID NO: 343 - RNA, 23 nt, synthetic construct
  source 1..23: mol_type = other RNA; note = Description of Artificial Sequence: Synthetic oligonucleotide
ttaatgataggtatctggaatgt

SEQ ID NO: 344 - RNA, 23 nt, synthetic construct
  source 1..23: mol_type = other RNA; note = Description of Artificial Sequence: Synthetic oligonucleotide
tgagtaatgataggtatctggaa

SEQ ID NO: 345 - RNA, 23 nt, synthetic construct
  source 1..23: mol_type = other RNA; note = Description of Artificial Sequence: Synthetic oligonucleotide
ttcgagtaatgataggtatctgg

SEQ ID NO: 346 - RNA, 23 nt, synthetic construct
  source 1..23: mol_type = other RNA; note = Description of Artificial Sequence: Synthetic oligonucleotide
ttaatttggatgagaaatcactt

SEQ ID NO: 347 - RNA, 23 nt, synthetic construct
  source 1..23: mol_type = other RNA; note = Description of Artificial Sequence: Synthetic oligonucleotide
tataatttggatgagaaatcact

SEQ ID NO: 348 - RNA, 23 nt, synthetic construct
  source 1..23: mol_type = other RNA; note = Description of Artificial Sequence: Synthetic oligonucleotide
ttcataatttggatgagaaatca

SEQ ID NO: 349 - RNA, 23 nt, synthetic construct
  source 1..23: mol_type = other RNA; note = Description of Artificial Sequence: Synthetic oligonucleotide
tgtcataatttggatgagaaatc

SEQ ID NO: 350 - RNA, 23 nt, synthetic construct
  source 1..23: mol_type = other RNA; note = Description of Artificial Sequence: Synthetic oligonucleotide
tagtcataatttggatgagaaat

SEQ ID NO: 351 - RNA, 23 nt, synthetic construct
  source 1..23: mol_type = other RNA; note = Description of Artificial Sequence: Synthetic oligonucleotide
ttaataaaaatgaagtgacctct

SEQ ID NO: 352 - RNA, 23 nt, synthetic construct
  source 1..23: mol_type = other RNA; note = Description of Artificial Sequence: Synthetic oligonucleotide
tgtagcaatgtgtagaaacataa

SEQ ID NO: 353 - RNA, 23 nt, synthetic construct
  source 1..23: mol_type = other RNA; note = Description of Artificial Sequence: Synthetic oligonucleotide
tagtttcaaagagttaaatgaag

SEQ ID NO: 354 - RNA, 23 nt, synthetic construct
  source 1..23: mol_type = other RNA; note = Description of Artificial Sequence: Synthetic oligonucleotide
tatttcaaggttaagtcctagct

SEQ ID NO: 355 - RNA, 23 nt, synthetic construct
  source 1..23: mol_type = other RNA; note = Description of Artificial Sequence: Synthetic oligonucleotide
tacaccttttaggatgtgtcttg

SEQ ID NO: 356 - RNA, 23 nt, synthetic construct
  source 1..23: mol_type = other RNA; note = Description of Artificial Sequence: Synthetic oligonucleotide
taacaccttttaggatgtgtctt

SEQ ID NO: 357 - RNA, 23 nt, synthetic construct
  source 1..23: mol_type = other RNA; note = Description of Artificial Sequence: Synthetic oligonucleotide
taaggaagacgttttcaccatta

SEQ ID NO: 358 - RNA, 23 nt, synthetic construct
  source 1..23: mol_type = other RNA; note = Description of Artificial Sequence: Synthetic oligonucleotide
taagaaggaagacgttttcacca

SEQ ID NO: 359 - RNA, 23 nt, synthetic construct
  source 1..23: mol_type = other RNA; note = Description of Artificial Sequence: Synthetic oligonucleotide
tataaagaaggaagacgttttca

SEQ ID NO: 360 - RNA, 23 nt, synthetic construct
  source 1..23: mol_type = other RNA; note = Description of Artificial Sequence: Synthetic oligonucleotide
ttgcttttgaagaacaggcatca

SEQ ID NO: 361 - RNA, 23 nt, synthetic construct
  source 1..23: mol_type = other RNA; note = Description of Artificial Sequence: Synthetic oligonucleotide
tactgcttttgaagaacaggcat

SEQ ID NO: 362 - RNA, 23 nt, synthetic construct
  source 1..23: mol_type = other RNA; note = Description of Artificial Sequence: Synthetic oligonucleotide
taagaaaccactgcttttgaaga

SEQ ID NO: 363 - RNA, 23 nt, synthetic construct
  source 1..23: mol_type = other RNA; note = Description of Artificial Sequence: Synthetic oligonucleotide
tacagcatcgagtaatgataggt

SEQ ID NO: 364 - RNA, 23 nt, synthetic construct
  source 1..23: mol_type = other RNA; note = Description of Artificial Sequence: Synthetic oligonucleotide
tttaagaggtttttccacgcagt

SEQ ID NO: 365 - RNA, 23 nt, synthetic construct
  source 1..23: mol_type = other RNA; note = Description of Artificial Sequence: Synthetic oligonucleotide
tgaaatcactttttctacttggt

SEQ ID NO: 366 - RNA, 23 nt, synthetic construct
  source 1..23: mol_type = other RNA; note = Description of Artificial Sequence: Synthetic oligonucleotide
tagaaatcactttttctacttgg

SEQ ID NO: 367 - RNA, 23 nt, synthetic construct
  source 1..23: mol_type = other RNA; note = Description of Artificial Sequence: Synthetic oligonucleotide
ttgagaaatcactttttctactt

SEQ ID NO: 368 - RNA, 23 nt, synthetic construct
  source 1..23: mol_type = other RNA; note = Description of Artificial Sequence: Synthetic oligonucleotide
tatgagaaatcactttttctact

SEQ ID NO: 369 - RNA, 23 nt, synthetic construct
  source 1..23: mol_type = other RNA; note = Description of Artificial Sequence: Synthetic oligonucleotide
tttggatgagaaatcactttttc

SEQ ID NO: 370 - RNA, 23 nt, synthetic construct
  source 1..23: mol_type = other RNA; note = Description of Artificial Sequence: Synthetic oligonucleotide
tcataatttggatgagaaatcac

SEQ ID NO: 371 - RNA, 23 nt, synthetic construct
  source 1..23: mol_type = other RNA; note = Description of Artificial Sequence: Synthetic oligonucleotide
ttcgttgaaagtcagaggcttct

SEQ ID NO: 372 - RNA, 23 nt, synthetic construct
  source 1..23: mol_type = other RNA; note = Description of Artificial Sequence: Synthetic oligonucleotide
tctcaatttccagtgactagcag

SEQ ID NO: 373 - RNA, 23 nt, synthetic construct
  source 1..23: mol_type = other RNA; note = Description of Artificial Sequence: Synthetic oligonucleotide
tactacttggagacatcaaaagc

SEQ ID NO: 374 - RNA, 23 nt, synthetic construct
  source 1..23: mol_type = other RNA; note = Description of Artificial Sequence: Synthetic oligonucleotide
tagtccaaaacaaaacacatctt

SEQ ID NO: 375 - RNA, 23 nt, synthetic construct
  source 1..23: mol_type = other RNA; note = Description of Artificial Sequence: Synthetic oligonucleotide
tacagagagtccaaaacaaaaca

SEQ ID NO: 376 - RNA, 23 nt, synthetic construct
  source 1..23: mol_type = other RNA; note = Description of Artificial Sequence: Synthetic oligonucleotide
ttttcattcttgcaaaccagcct

SEQ ID NO: 377 - RNA, 23 nt, synthetic construct
  source 1..23: mol_type = other RNA; note = Description of Artificial Sequence: Synthetic oligonucleotide
tcatttcattcttgcaaaccagc

SEQ ID NO: 378 - RNA, 23 nt, synthetic construct
  source 1..23: mol_type = other RNA; note = Description of Artificial Sequence: Synthetic oligonucleotide
ttcatttcattcttgcaaaccag

SEQ ID NO: 379 - RNA, 23 nt, synthetic construct
  source 1..23: mol_type = other RNA; note = Description of Artificial Sequence: Synthetic oligonucleotide
tcatttcaaggttaagtcctagc

SEQ ID NO: 380 - RNA, 23 nt, synthetic construct
  source 1..23: mol_type = other RNA; note = Description of Artificial Sequence: Synthetic oligonucleotide
tagaaggaagacgttttcaccat

SEQ ID NO: 381 - RNA, 23 nt, synthetic construct
  source 1..23: mol_type = other RNA; note = Description of Artificial Sequence: Synthetic oligonucleotide
tgcaataaagaaggaagacgttt

SEQ ID NO: 382 - RNA, 23 nt, synthetic construct
  source 1..23: mol_type = other RNA; note = Description of Artificial Sequence: Synthetic oligonucleotide
tggcaataaagaaggaagacgtt

SEQ ID NO: 383 - RNA, 23 nt, synthetic construct
  source 1..23: mol_type = other RNA; note = Description of Artificial Sequence: Synthetic oligonucleotide
tttcacaattgaactttacagtt

SEQ ID NO: 384 - RNA, 23 nt, synthetic construct
  source 1..23: mol_type = other RNA; note = Description of Artificial Sequence: Synthetic oligonucleotide
ttttcttagtctttgaggtgcac

SEQ ID NO: 385 - RNA, 23 nt, synthetic construct
  source 1..23: mol_type = other RNA; note = Description of Artificial Sequence: Synthetic oligonucleotide
tctttcttagtctttgaggtgca

SEQ ID NO: 386 - RNA, 23 nt, synthetic construct
  source 1..23: mol_type = other RNA; note = Description of Artificial Sequence: Synthetic oligonucleotide
tgtttcataaagctggtggatcc

SEQ ID NO: 387 - RNA, 23 nt, synthetic construct
  source 1..23: mol_type = other RNA; note = Description of Artificial Sequence: Synthetic oligonucleotide
tcttttgaagaacaggcatcact

SEQ ID NO: 388 - RNA, 23 nt, synthetic construct
  source 1..23: mol_type = other RNA; note = Description of Artificial Sequence: Synthetic oligonucleotide
tgcttttgaagaacaggcatcac

SEQ ID NO: 389 - RNA, 23 nt, synthetic construct
  source 1..23: mol_type = other RNA; note = Description of Artificial Sequence: Synthetic oligonucleotide
tctgcttttgaagaacaggcatc

SEQ ID NO: 390 - RNA, 23 nt, synthetic construct
  source 1..23: mol_type = other RNA; note = Description of Artificial Sequence: Synthetic oligonucleotide
tgaaaccactgcttttgaagaac

SEQ ID NO: 391 - RNA, 23 nt, synthetic construct
  source 1..23: mol_type = other RNA; note = Description of Artificial Sequence: Synthetic oligonucleotide
taatgataggtatctggaatgtt

SEQ ID NO: 392 - RNA, 23 nt, synthetic construct
  source 1..23: mol_type = other RNA; note = Description of Artificial Sequence: Synthetic oligonucleotide
tagcatcgagtaatgataggtat

SEQ ID NO: 393 - RNA, 23 nt, synthetic construct
  source 1..23: mol_type = other RNA; note = Description of Artificial Sequence: Synthetic oligonucleotide
tgttaagaggtttttccacgcag

SEQ ID NO: 394 - RNA, 23 nt, synthetic construct
  source 1..23: mol_type = other RNA; note = Description of Artificial Sequence: Synthetic oligonucleotide
tatcaacagcatcgagtaatgat

SEQ ID NO: 395 - RNA, 23 nt, synthetic construct
  source 1..23: mol_type = other RNA; note = Description of Artificial Sequence: Synthetic oligonucleotide
tttatcaacagcatcgagtaatg

SEQ ID NO: 396 - RNA, 23 nt, synthetic construct
  source 1..23: mol_type = other RNA; note = Description of Artificial Sequence: Synthetic oligonucleotide
tagcgcaatgtcattgttcttgg

SEQ ID NO: 397 - RNA, 23 nt, synthetic construct
  source 1..23: mol_type = other RNA; note = Description of Artificial Sequence: Synthetic oligonucleotide
tgttcaaagccatcttgctgtta

SEQ ID NO: 398 - RNA, 23 nt, synthetic construct
  source 1..23: mol_type = other RNA; note = Description of Artificial Sequence: Synthetic oligonucleotide
tagttcaaagccatcttgctgtt

SEQ ID NO: 399 - RNA, 23 nt, synthetic construct
  source 1..23: mol_type = other RNA; note = Description of Artificial Sequence: Synthetic oligonucleotide
taaaaatgaagtgacctctgaat

SEQ ID NO: 400 - RNA, 23 nt, synthetic construct
  source 1..23: mol_type = other RNA; note = Description of Artificial Sequence: Synthetic oligonucleotide
ttaaaaatgaagtgacctctgaa

SEQ ID NO: 401 - RNA, 23 nt, synthetic construct
  source 1..23: mol_type = other RNA; note = Description of Artificial Sequence: Synthetic oligonucleotide
tcaatgtgtagaaacataacatg

SEQ ID NO: 402 - RNA, 23 nt, synthetic construct
  source 1..23: mol_type = other RNA; note = Description of Artificial Sequence: Synthetic oligonucleotide
ttagcaatgtgtagaaacataac

SEQ ID NO: 403 - RNA, 23 nt, synthetic construct
  source 1..23: mol_type = other RNA; note = Description of Artificial Sequence: Synthetic oligonucleotide
tcacattcatttatagaacgtta

SEQ ID NO: 404 - RNA, 23 nt, synthetic construct
  source 1..23: mol_type = other RNA; note = Description of Artificial Sequence: Synthetic oligonucleotide
tcagagagtccaaaacaaaacac

SEQ ID NO: 405 - RNA, 23 nt, synthetic construct
  source 1..23: mol_type = other RNA; note = Description of Artificial Sequence: Synthetic oligonucleotide
tttcatttcattcttgcaaacca

SEQ ID NO: 406 - RNA, 23 nt, synthetic construct
  source 1..23: mol_type = other RNA; note = Description of Artificial Sequence: Synthetic oligonucleotide
tgaatcattcatttcattcttgc

SEQ ID NO: 407 - RNA, 23 nt, synthetic construct
  source 1..23: mol_type = other RNA; note = Description of Artificial Sequence: Synthetic oligonucleotide
ttttcaaggttaagtcctagctg

SEQ ID NO: 408 - RNA, 23 nt, synthetic construct
  source 1..23: mol_type = other RNA; note = Description of Artificial Sequence: Synthetic oligonucleotide
tcaccttttaggatgtgtcttgg

SEQ ID NO: 409 - RNA, 23 nt, synthetic construct
  source 1..23: mol_type = other RNA; note = Description of Artificial Sequence: Synthetic oligonucleotide
taagacgttttcaccattacaac

SEQ ID NO: 410 - RNA, 23 nt, synthetic construct
  source 1..23: mol_type = other RNA; note = Description of Artificial Sequence: Synthetic oligonucleotide
taggaagacgttttcaccattac

SEQ ID NO: 411 - RNA, 23 nt, synthetic construct
  source 1..23: mol_type = other RNA; note = Description of Artificial Sequence: Synthetic oligonucleotide
ttcacaattgaactttacagttt

SEQ ID NO: 412 - RNA, 23 nt, synthetic construct
  source 1..23: mol_type = other RNA; note = Description of Artificial Sequence: Synthetic oligonucleotide
ttttcacaattgaactttacagt

SEQ ID NO: 413 - RNA, 23 nt, synthetic construct
  source 1..23: mol_type = other RNA; note = Description of Artificial Sequence: Synthetic oligonucleotide
tgctttcttagtctttgaggtgc

SEQ ID NO: 414 - RNA, 23 nt, synthetic construct
  source 1..23: mol_type = other RNA; note = Description of Artificial Sequence: Synthetic oligonucleotide
ttgctttcttagtctttgaggtg

SEQ ID NO: 415 - RNA, 23 nt, synthetic construct
  source 1..23: mol_type = other RNA; note = Description of Artificial Sequence: Synthetic oligonucleotide
tgtgctttcttagtctttgaggt

SEQ ID NO: 416 - RNA, 23 nt, synthetic construct
  source 1..23: mol_type = other RNA; note = Description of Artificial Sequence: Synthetic oligonucleotide
ttcagtttcataaagctggtgga

SEQ ID NO: 417 - RNA, 23 nt, synthetic construct
  source 1..23: mol_type = other RNA; note = Description of Artificial Sequence: Synthetic oligonucleotide
tatagatatcgacattgccggca

SEQ ID NO: 418 - RNA, 23 nt, synthetic construct
  source 1..23: mol_type = other RNA; note = Description of Artificial Sequence: Synthetic oligonucleotide
taaccactgcttttgaagaacag

SEQ ID NO: 419 - RNA, 23 nt, synthetic construct
  source 1..23: mol_type = other RNA; note = Description of Artificial Sequence: Synthetic oligonucleotide
tagaaaccactgcttttgaagaa

SEQ ID NO: 420 - RNA, 23 nt, synthetic construct
  source 1..23: mol_type = other RNA; note = Description of Artificial Sequence: Synthetic oligonucleotide
ttaggtatctggaatgttcaata

SEQ ID NO: 421 - RNA, 23 nt, synthetic construct
  source 1..23: mol_type = other RNA; note = Description of Artificial Sequence: Synthetic oligonucleotide
tatgataggtatctggaatgttc

SEQ ID NO: 422 - RNA, 23 nt, synthetic construct
  source 1..23: mol_type = other RNA; note = Description of Artificial Sequence: Synthetic oligonucleotide
ttcaacagcatcgagtaatgata

SEQ ID NO: 423 - RNA, 23 nt, synthetic construct
  source 1..23: mol_type = other RNA; note = Description of Artificial Sequence: Synthetic oligonucleotide
tgagaaatcactttttctacttg

SEQ ID NO: 424 - RNA, 23 nt, synthetic construct
  source 1..23: mol_type = other RNA; note = Description of Artificial Sequence: Synthetic oligonucleotide
tcattgttcttggtcttggagtc

SEQ ID NO: 425 - RNA, 23 nt, synthetic construct
  source 1..23: mol_type = other RNA; note = Description of Artificial Sequence: Synthetic oligonucleotide
ttgtcattgttcttggtcttgga

SEQ ID NO: 426 - RNA, 23 nt, synthetic construct
  source 1..23: mol_type = other RNA; note = Description of Artificial Sequence: Synthetic oligonucleotide
tctgagttcaaagccatcttgct

SEQ ID NO: 427 - RNA, 23 nt, synthetic construct
  source 1..23: mol_type = other RNA; note = Description of Artificial Sequence: Synthetic oligonucleotide
tttacaagtgactaccacgtcac

SEQ ID NO: 428 - RNA, 23 nt, synthetic construct
  source 1..23: mol_type = other RNA; note = Description of Artificial Sequence: Synthetic oligonucleotide
tgcaatgtgtagaaacataacat

SEQ ID NO: 429 - RNA, 23 nt, synthetic construct
  source 1..23: mol_type = other RNA; note = Description of Artificial Sequence: Synthetic oligonucleotide
tattcatttcattcttgcaaacc

SEQ ID NO: 430 - RNA, 23 nt, synthetic construct
  source 1..23: mol_type = other RNA; note = Description of Artificial Sequence: Synthetic oligonucleotide
tccatttcaaggttaagtcctag

SEQ ID NO: 431 - RNA, 23 nt, synthetic construct
  source 1..23: mol_type = other RNA; note = Description of Artificial Sequence: Synthetic oligonucleotide
tgcatgatattcattttcacaat

SEQ ID NO: 432 - RNA, 23 nt, synthetic construct
  source 1..23: mol_type = other RNA; note = Description of Artificial Sequence: Synthetic oligonucleotide
ttttgaagaacaggcatcactgt

SEQ ID NO: 433 - RNA, 23 nt, synthetic construct
  source 1..23: mol_type = other RNA; note = Description of Artificial Sequence: Synthetic oligonucleotide
taaaccactgcttttgaagaaca

SEQ ID NO: 434 - RNA, 23 nt, synthetic construct
  source 1..23: mol_type = other RNA; note = Description of Artificial Sequence: Synthetic oligonucleotide
taaagaaaccactgcttttgaag

SEQ ID NO: 435 - RNA, 23 nt, synthetic construct
  source 1..23: mol_type = other RNA; note = Description of Artificial Sequence: Synthetic oligonucleotide
ttaaagaaaccactgcttttgaa

SEQ ID NO: 436 - RNA, 23 nt, synthetic construct
  source 1..23: mol_type = other RNA; note = Description of Artificial Sequence: Synthetic oligonucleotide
tctatacagcgtaaagaaaccac

SEQ ID NO: 437 - RNA, 23 nt, synthetic construct
  source 1..23: mol_type = other RNA; note = Description of Artificial Sequence: Synthetic oligonucleotide
tcatcgagtaatgataggtatct

SEQ ID NO: 438 - RNA, 23 nt, synthetic construct
  source 1..23: mol_type = other RNA; note = Description of Artificial Sequence: Synthetic oligonucleotide
tcaacagcatcgagtaatgatag

SEQ ID NO: 439 - RNA, 23 nt, synthetic construct
  source 1..23: mol_type = other RNA; note = Description of Artificial Sequence: Synthetic oligonucleotide
ttggatgagaaatcactttttct

SEQ ID NO: 440 - RNA, 23 nt, synthetic construct
  source 1..23: mol_type = other RNA; note = Description of Artificial Sequence: Synthetic oligonucleotide
tattgttcttggtcttggagtca

SEQ ID NO: 441 - RNA, 23 nt, synthetic construct
  source 1..23: mol_type = other RNA; note = Description of Artificial Sequence: Synthetic oligonucleotide
tgtcattgttcttggtcttggag

SEQ ID NO: 442 - RNA, 23 nt, synthetic construct
  source 1..23: mol_type = other RNA; note = Description of Artificial Sequence: Synthetic oligonucleotide
tatgtcattgttcttggtcttgg

SEQ ID NO: 443 - RNA, 23 nt, synthetic construct
  source 1..23: mol_type = other RNA; note = Description of Artificial Sequence: Synthetic oligonucleotide
ttcatttgtcgataaatccagtc

SEQ ID NO: 444 - RNA, 23 nt, synthetic construct
  source 1..23: mol_type = other RNA; note = Description of Artificial Sequence: Synthetic oligonucleotide
taaaatgaagtgacctctgaatc

SEQ ID NO: 445 - RNA, 23 nt, synthetic construct
  source 1..23: mol_type = other RNA; note = Description of Artificial Sequence: Synthetic oligonucleotide
tataaaaatgaagtgacctctga

SEQ ID NO: 446 - RNA, 23 nt, synthetic construct
  source 1..23: mol_type = other RNA; note = Description of Artificial Sequence: Synthetic oligonucleotide
taataaaaatgaagtgacctctg

SEQ ID NO: 447 - RNA, 23 nt, synthetic construct
  source 1..23: mol_type = other RNA; note = Description of Artificial Sequence: Synthetic oligonucleotide
taacaaaaatgtttctgttcccc

SEQ ID NO: 448 - RNA, 23 nt, synthetic construct
  source 1..23: mol_type = other RNA; note = Description of Artificial Sequence: Synthetic oligonucleotide
ttcaatttccagtgactagcagg

SEQ ID NO: 449 - RNA, 23 nt, synthetic construct
  source 1..23: mol_type = other RNA; note = Description of Artificial Sequence: Synthetic oligonucleotide
tagcaatgtgtagaaacataaca

SEQ ID NO: 450 - RNA, 23 nt, synthetic construct
  source 1..23: mol_type = other RNA; note = Description of Artificial Sequence: Synthetic oligonucleotide
tctacttggagacatcaaaagct

SEQ ID NO: 451 - RNA, 23 nt, synthetic construct
  source 1..23: mol_type = other RNA; note = Description of Artificial Sequence: Synthetic oligonucleotide
ttggactacttggagacatcaaa

SEQ ID NO: 452 - RNA, 23 nt, synthetic construct
  source 1..23: mol_type = other RNA; note = Description of Artificial Sequence: Synthetic oligonucleotide
tcagcacattcatttatagaacg

SEQ ID NO: 453 - RNA, 23 nt, synthetic construct
  source 1..23: mol_type = other RNA; note = Description of Artificial Sequence: Synthetic oligonucleotide
tagaatcattcatttcattcttg

SEQ ID NO: 454 - RNA, 23 nt, synthetic construct
  source 1..23: mol_type = other RNA; note = Description of Artificial Sequence: Synthetic oligonucleotide
tgtagaatcattcatttcattct

SEQ ID NO: 455 - RNA, 23 nt, synthetic construct
  source 1..23: mol_type = other RNA; note = Description of Artificial Sequence: Synthetic oligonucleotide
ttccatttcaaggttaagtccta

SEQ ID NO: 456 - RNA, 23 nt, synthetic construct
  source 1..23: mol_type = other RNA; note = Description of Artificial Sequence: Synthetic oligonucleotide
tttccatttcaaggttaagtcct

SEQ ID NO: 457 - RNA, 23 nt, synthetic construct
  source 1..23: mol_type = other RNA; note = Description of Artificial Sequence: Synthetic oligonucleotide
tgcaaatgggattgcatgacttt

SEQ ID NO: 458 - RNA, 23 nt, synthetic construct
  source 1..23: mol_type = other RNA; note = Description of Artificial Sequence: Synthetic oligonucleotide
ttgcaaatgggattgcatgactt

SEQ ID NO: 459 - RNA, 23 nt, synthetic construct
  source 1..23: mol_type = other RNA; note = Description of Artificial Sequence: Synthetic oligonucleotide
ttcttagtctttgaggtgcacac

SEQ ID NO: 460 - RNA, 23 nt, synthetic construct
  source 1..23: mol_type = other RNA; note = Description of Artificial Sequence: Synthetic oligonucleotide
tagtttcataaagctggtggatc

SEQ ID NO: 461 - RNA, 23 nt, synthetic construct
  source 1..23: mol_type = other RNA; note = Description of Artificial Sequence: Synthetic oligonucleotide
tgtgttcagtttcataaagctgg

SEQ ID NO: 462 - RNA, 23 nt, synthetic construct
  source 1..23: mol_type = other RNA; note = Description of Artificial Sequence: Synthetic oligonucleotide
tgcacttgtgttcagtttcataa

SEQ ID NO: 463 - RNA, 23 nt, synthetic construct
  source 1..23: mol_type = other RNA; note = Description of Artificial Sequence: Synthetic oligonucleotide
taggtatctggaatgttcaatat

SEQ ID NO: 464 - RNA, 23 nt, synthetic construct
  source 1..23: mol_type = other RNA; note = Description of Artificial Sequence: Synthetic oligonucleotide
tgtaaagaaaccactgcttttga

SEQ ID NO: 465 - RNA, 23 nt, synthetic construct
  source 1..23: mol_type = other RNA; note = Description of Artificial Sequence: Synthetic oligonucleotide
tgctatacagcgtaaagaaacca

SEQ ID NO: 466 - RNA, 23 nt, synthetic construct
  source 1..23: mol_type = other RNA; note = Description of Artificial Sequence: Synthetic oligonucleotide
ttatcaacagcatcgagtaatga

SEQ ID NO: 467 - RNA, 23 nt, synthetic construct
  source 1..23: mol_type = other RNA; note = Description of Artificial Sequence: Synthetic oligonucleotide
tcaatgtcattgttcttggtctt

SEQ ID NO: 468 - RNA, 23 nt, synthetic construct
  source 1..23: mol_type = other RNA; note = Description of Artificial Sequence: Synthetic oligonucleotide
tgcaatgtcattgttcttggtct

SEQ ID NO: 469 - RNA, 23 nt, synthetic construct
  source 1..23: mol_type = other RNA; note = Description of Artificial Sequence: Synthetic oligonucleotide
tgagttcaaagccatcttgctgt

SEQ ID NO: 470 - RNA, 23 nt, synthetic construct
  source 1..23: mol_type = other RNA; note = Description of Artificial Sequence: Synthetic oligonucleotide
tgtcgataaatccagtccgtgaa

SEQ ID NO: 471 - RNA, 23 nt, synthetic construct
  source 1..23: mol_type = other RNA; note = Description of Artificial Sequence: Synthetic oligonucleotide
ttgtcgataaatccagtccgtga

SEQ ID NO: 472 - RNA, 23 nt, synthetic construct
  source 1..23: mol_type = other RNA; note = Description of Artificial Sequence: Synthetic oligonucleotide
tctcatttgtcgataaatccagt

SEQ ID NO: 473 - RNA, 23 nt, synthetic construct
  source 1..23: mol_type = other RNA; note = Description of Artificial Sequence: Synthetic oligonucleotide
tcttacaagtgactaccacgtca

SEQ ID NO: 474 - RNA, 23 nt, synthetic construct
  source 1..23: mol_type = other RNA; note = Description of Artificial Sequence: Synthetic oligonucleotide
tacctcaatttccagtgactagc

SEQ ID NO: 475 - RNA, 23 nt, synthetic construct
  source 1..23: mol_type = other RNA; note = Description of Artificial Sequence: Synthetic oligonucleotide
taaactgagcatccttgatttcc

SEQ ID NO: 476 - RNA, 23 nt, synthetic construct
  source 1..23: mol_type = other RNA; note = Description of Artificial Sequence: Synthetic oligonucleotide
ttcagcacattcatttatagaac

SEQ ID NO: 477 - RNA, 23 nt, synthetic construct
  source 1..23: mol_type = other RNA; note = Description of Artificial Sequence: Synthetic oligonucleotide
tcttcagcacattcatttataga

SEQ ID NO: 478 - RNA, 23 nt, synthetic construct
  source 1..23: mol_type = other RNA; note = Description of Artificial Sequence: Synthetic oligonucleotide
tcacagagagtccaaaacaaaac

SEQ ID NO: 479 - RNA, 23 nt, synthetic construct
  source 1..23: mol_type = other RNA; note = Description of Artificial Sequence: Synthetic oligonucleotide
tttcattcttgcaaaccagcctg

SEQ ID NO: 480 - RNA, 23 nt, synthetic construct
  source 1..23: mol_type = other RNA; note = Description of Artificial Sequence: Synthetic oligonucleotide
tttcaaggttaagtcctagctgt

SEQ ID NO: 481 - RNA, 23 nt, synthetic construct
  source 1..23: mol_type = other RNA; note = Description of Artificial Sequence: Synthetic oligonucleotide
tgacagatcctgcaaatgggatt

SEQ ID NO: 482 - RNA, 23 nt, synthetic construct
  source 1..23: mol_type = other RNA; note = Description of Artificial Sequence: Synthetic oligonucleotide
tcattttcacaattgaactttac

SEQ ID NO: 483 - RNA, 23 nt, synthetic construct
  source 1..23: mol_type = other RNA; note = Description of Artificial Sequence: Synthetic oligonucleotide
tttcttagtctttgaggtgcaca

SEQ ID NO: 484 - RNA, 23 nt, synthetic construct
  source 1..23: mol_type = other RNA; note = Description of Artificial Sequence: Synthetic oligonucleotide
tacagtgctttcttagtctttga

SEQ ID NO: 485 - RNA, 23 nt, synthetic construct
  source 1..23: mol_type = other RNA; note = Description of Artificial Sequence: Synthetic oligonucleotide
tctctgagatgagtacacctgaa

SEQ ID NO: 486 - RNA, 23 nt, synthetic construct
  source 1..23: mol_type = other RNA; note = Description of Artificial Sequence: Synthetic oligonucleotide
tcactattccttggctagagtaa

SEQ ID NO: 487 - RNA, 23 nt, synthetic construct
  source 1..23: mol_type = other RNA; note = Description of Artificial Sequence: Synthetic oligonucleotide
tttgaagaacaggcatcactgtg

SEQ ID NO: 488 - RNA, 23 nt, synthetic construct
  source 1..23: mol_type = other RNA; note = Description of Artificial Sequence: Synthetic oligonucleotide
tcgtaaagaaaccactgcttttg

SEQ ID NO: 489 - RNA, 23 nt, synthetic construct
  source 1..23: mol_type = other RNA; note = Description of Artificial Sequence: Synthetic oligonucleotide
tcagcgtaaagaaaccactgctt

SEQ ID NO: 490 - RNA, 23 nt, synthetic construct
  source 1..23: mol_type = other RNA; note = Description of Artificial Sequence: Synthetic oligonucleotide
tacagcgtaaagaaaccactgct

SEQ ID NO: 491 - RNA, 23 nt, synthetic construct
  source 1..23: mol_type = other RNA; note = Description of Artificial Sequence: Synthetic oligonucleotide
tcagcatcgagtaatgataggta

SEQ ID NO: 492 - RNA, 23 nt, synthetic construct
  source 1..23: mol_type = other RNA; note = Description of Artificial Sequence: Synthetic oligonucleotide
tgttcttggtcttggagtcataa

SEQ ID NO: 493 - RNA, 23 nt, synthetic construct
  source 1..23: mol_type = other RNA; note = Description of Artificial Sequence: Synthetic oligonucleotide
ttcattgttcttggtcttggagt

SEQ ID NO: 494 - RNA, 23 nt, synthetic construct
  source 1..23: mol_type = other RNA; note = Description of Artificial Sequence: Synthetic oligonucleotide
tcgataaatccagtccgtgaata

SEQ ID NO: 495 - RNA, 23 nt, synthetic construct
  source 1..23: mol_type = other RNA; note = Description of Artificial Sequence: Synthetic oligonucleotide
tatgaagtgacctctgaatcatc

SEQ ID NO: 496 - RNA, 23 nt, synthetic construct
  source 1..23: mol_type = other RNA; note = Description of Artificial Sequence: Synthetic oligonucleotide
taatgaagtgacctctgaatcat

SEQ ID NO: 497 - RNA, 23 nt, synthetic construct
  source 1..23: mol_type = other RNA; note = Description of Artificial Sequence: Synthetic oligonucleotide
taaatgaagtgacctctgaatca

SEQ ID NO: 498 - RNA, 23 nt, synthetic construct
  source 1..23: mol_type = other RNA; note = Description of Artificial Sequence: Synthetic oligonucleotide
tgacctcaatttccagtgactag

SEQ ID NO: 499 - RNA, 23 nt, synthetic construct
  source 1..23: mol_type = other RNA; note = Description of Artificial Sequence: Synthetic oligonucleotide
taggtagcaatgtgtagaaacat

SEQ ID NO: 500 - RNA, 23 nt, synthetic construct
  source 1..23: mol_type = other RNA; note = Description of Artificial Sequence: Synthetic oligonucleotide
tgaggtagcaatgtgtagaaaca

SEQ ID NO: 501 - RNA, 23 nt, synthetic construct
  source 1..23: mol_type = other RNA; note = Description of Artificial Sequence: Synthetic oligonucleotide
tggactacttggagacatcaaaa

SEQ ID NO: 502 - RNA, 23 nt, synthetic construct
  source 1..23: mol_type = other RNA; note = Description of Artificial Sequence: Synthetic oligonucleotide
tagcacattcatttatagaacgt

SEQ ID NO: 503 - RNA, 23 nt, synthetic construct
  source 1..23: mol_type = other RNA; note = Description of Artificial Sequence: Synthetic oligonucleotide
taccacagagagtccaaaacaaa

SEQ ID NO: 504 - RNA, 23 nt, synthetic construct
  source 1..23: mol_type = other RNA; note = Description of Artificial Sequence: Synthetic oligonucleotide
ttagagtagtgctcatggttatg

SEQ ID NO: 505 - RNA, 23 nt, synthetic construct
  source 1..23: mol_type = other RNA; note = Description of Artificial Sequence: Synthetic oligonucleotide
tattcttgcaaaccagcctgctt

SEQ ID NO: 506 - RNA, 23 nt, synthetic construct
  source 1..23: mol_type = other RNA; note = Description of Artificial Sequence: Synthetic oligonucleotide
taatcattcatttcattcttgca

SEQ ID NO: 507 - RNA, 23 nt, synthetic construct
  source 1..23: mol_type = other RNA; note = Description of Artificial Sequence: Synthetic oligonucleotide
tcacagtgctttcttagtctttg

SEQ ID NO: 508 - RNA, 23 nt, synthetic construct
  source 1..23: mol_type = other RNA; note = Description of Artificial Sequence: Synthetic oligonucleotide
ttgagatgagtacacctgaagga

SEQ ID NO: 509 - RNA, 23 nt, synthetic construct
  source 1..23: mol_type = other RNA; note = Description of Artificial Sequence: Synthetic oligonucleotide
tctgagatgagtacacctgaagg

SEQ ID NO: 510 - RNA, 23 nt, synthetic construct
  source 1..23: mol_type = other RNA; note = Description of Artificial Sequence: Synthetic oligonucleotide
tcagtttcataaagctggtggat

SEQ ID NO: 511 - RNA, 23 nt, synthetic construct
  source 1..23: mol_type = other RNA; note = Description of Artificial Sequence: Synthetic oligonucleotide
tgcgtaaagaaaccactgctttt

SEQ ID NO: 512 - RNA, 23 nt, synthetic construct
  source 1..23: mol_type = other RNA; note = Description of Artificial Sequence: Synthetic oligonucleotide
tagcgtaaagaaaccactgcttt

SEQ ID NO: 513 - RNA, 23 nt, synthetic construct
  source 1..23: mol_type = other RNA; note = Description of Artificial Sequence: Synthetic oligonucleotide
tgcgcaatgtcattgttcttggt

SEQ ID NO: 514 - RNA, 23 nt, synthetic construct
  source 1..23: mol_type = other RNA; note = Description of Artificial Sequence: Synthetic oligonucleotide
tttgtcgataaatccagtccgtg

SEQ ID NO: 515 - RNA, 23 nt, synthetic construct
  source 1..23: mol_type = other RNA; note = Description of Artificial Sequence: Synthetic oligonucleotide
tcctcatttgtcgataaatccag

SEQ ID NO: 516 - RNA, 23 nt, synthetic construct
  source 1..23: mol_type = other RNA; note = Description of Artificial Sequence: Synthetic oligonucleotide
ttacaagtgactaccacgtcacc

SEQ ID NO: 517 - RNA, 23 nt, synthetic construct
  source 1..23: mol_type = other RNA; note = Description of Artificial Sequence: Synthetic oligonucleotide
tgcacattcatttatagaacgtt

SEQ ID NO: 518 - RNA, 23 nt, synthetic construct
  source 1..23: mol_type = other RNA; note = Description of Artificial Sequence: Synthetic oligonucleotide
taaaacaaaacacatctttctct

SEQ ID NO: 519 - RNA, 23 nt, synthetic construct
  source 1..23: mol_type = other RNA; note = Description of Artificial Sequence: Synthetic oligonucleotide
tcaaaacaaaacacatctttctc

SEQ ID NO: 520 - RNA, 23 nt, synthetic construct
  source 1..23: mol_type = other RNA; note = Description of Artificial Sequence: Synthetic oligonucleotide
tgtccaaaacaaaacacatcttt

SEQ ID NO: 521 - RNA, 23 nt, synthetic construct
  source 1..23: mol_type = other RNA; note = Description of Artificial Sequence: Synthetic oligonucleotide
tcattcatttcattcttgcaaac

SEQ ID NO: 522 - RNA, 23 nt, synthetic construct
  source 1..23: mol_type = other RNA; note = Description of Artificial Sequence: Synthetic oligonucleotide
ttcattcatttcattcttgcaaa

SEQ ID NO: 523 - RNA, 23 nt, synthetic construct
  source 1..23: mol_type = other RNA; note = Description of Artificial Sequence: Synthetic oligonucleotide
tatcattcatttcattcttgcaa

SEQ ID NO: 524 - RNA, 23 nt, synthetic construct
  source 1..23: mol_type = other RNA; note = Description of Artificial Sequence: Synthetic oligonucleotide
tcaaatgggattgcatgactttc

SEQ ID NO: 525 - RNA, 23 nt, synthetic construct
  source 1..23: mol_type = other RNA; note = Description of Artificial Sequence: Synthetic oligonucleotide
tacagatcctgcaaatgggattg

SEQ ID NO: 526 - RNA, 23 nt, synthetic construct
  source 1..23: mol_type = other RNA; note = Description of Artificial Sequence: Synthetic oligonucleotide
tggaatgctgctctctacagagg

SEQ ID NO: 527 - RNA, 23 nt, synthetic construct
  source 1..23: mol_type = other RNA; note = Description of Artificial Sequence: Synthetic oligonucleotide
tggaagacgttttcaccattaca

SEQ ID NO: 528 - RNA, 23 nt, synthetic construct
  source 1..23: mol_type = other RNA; note = Description of Artificial Sequence: Synthetic oligonucleotide
ttgcatgatattcattttcacaa

SEQ ID NO: 529 - RNA, 23 nt, synthetic construct
  source 1..23: mol_type = other RNA; note = Description of Artificial Sequence: Synthetic oligonucleotide
tttgcatgatattcattttcaca

SEQ ID NO: 530 - RNA, 23 nt, synthetic construct
  source 1..23: mol_type = other RNA; note = Description of Artificial Sequence: Synthetic oligonucleotide
tgagatgagtacacctgaaggat

SEQ ID NO: 531 - RNA, 23 nt, synthetic construct
  source 1..23: mol_type = other RNA; note = Description of Artificial Sequence: Synthetic oligonucleotide
tcgtagttctcgttccagtcgtc

SEQ ID NO: 532 - RNA, 23 nt, synthetic construct
  source 1..23: mol_type = other RNA; note = Description of Artificial Sequence: Synthetic oligonucleotide
tattcttatagcccatgtccctg

SEQ ID NO: 533 - RNA, 23 nt, synthetic construct
  source 1..23: mol_type = other RNA; note = Description of Artificial Sequence: Synthetic oligonucleotide
tattccttggctagagtaaaaat

SEQ ID NO: 534 - RNA, 23 nt, synthetic construct
  source 1..23: mol_type = other RNA; note = Description of Artificial Sequence: Synthetic oligonucleotide
tactattccttggctagagtaaa

SEQ ID NO: 535 - RNA, 23 nt, synthetic construct
  source 1..23: mol_type = other RNA; note = Description of Artificial Sequence: Synthetic oligonucleotide
tcacttgtgttcagtttcataaa

SEQ ID NO: 536 - RNA, 23 nt, synthetic construct
  source 1..23: mol_type = other RNA; note = Description of Artificial Sequence: Synthetic oligonucleotide
tgcatcgagtaatgataggtatc

SEQ ID NO: 537 - RNA, 23 nt, synthetic construct
  source 1..23: mol_type = other RNA; note = Description of Artificial Sequence: Synthetic oligonucleotide
tgataaatccagtccgtgaatac

SEQ ID NO: 538 - RNA, 23 nt, synthetic construct
  source 1..23: mol_type = other RNA; note = Description of Artificial Sequence: Synthetic oligonucleotide
ttcgataaatccagtccgtgaat

SEQ ID NO: 539 - RNA, 23 nt, synthetic construct
  source 1..23: mol_type = other RNA; note = Description of Artificial Sequence: Synthetic oligonucleotide
tttggtatccatggttttcatag

SEQ ID NO: 540 - RNA, 23 nt, synthetic construct
  source 1..23: mol_type = other RNA; note = Description of Artificial Sequence: Synthetic oligonucleotide
tccttacaagtgactaccacgtc

SEQ ID NO: 541 - RNA, 23 nt, synthetic construct
  source 1..23: mol_type = other RNA; note = Description of Artificial Sequence: Synthetic oligonucleotide
tcacatctttctcttcttcgccg

SEQ ID NO: 542 - RNA, 23 nt, synthetic construct
  source 1..23: mol_type = other RNA; note = Description of Artificial Sequence: Synthetic oligonucleotide
taacacatctttctcttcttcgc

SEQ ID NO: 543 - RNA, 23 nt, synthetic construct
  source 1..23: mol_type = other RNA; note = Description of Artificial Sequence: Synthetic oligonucleotide
taaacacatctttctcttcttcg

SEQ ID NO: 544 - RNA, 23 nt, synthetic construct
  source 1..23: mol_type = other RNA; note = Description of Artificial Sequence: Synthetic oligonucleotide
taaaacacatctttctcttcttc

SEQ ID NO: 545 - RNA, 23 nt, synthetic construct
  source 1..23: mol_type = other RNA; note = Description of Artificial Sequence: Synthetic oligonucleotide
tagagtagtgctcatggttatgg

SEQ ID NO: 546 - RNA, 23 nt, synthetic construct
  source 1..23: mol_type = other RNA; note = Description of Artificial Sequence: Synthetic oligonucleotide
tcattcttgcaaaccagcctgct

SEQ ID NO: 547 - RNA, 23 nt, synthetic construct
  source 1..23: mol_type = other RNA; note = Description of Artificial Sequence: Synthetic oligonucleotide
tctgcaaatgggattgcatgact

SEQ ID NO: 548 - RNA, 23 nt, synthetic construct
  source 1..23: mol_type = other RNA; note = Description of Artificial Sequence: Synthetic oligonucleotide
tagacagatcctgcaaatgggat

SEQ ID NO: 549 - RNA, 23 nt, synthetic construct
  source 1..23: mol_type = other RNA; note = Description of Artificial Sequence: Synthetic oligonucleotide
taggacttcctctgagatgagta

SEQ ID NO: 550 - RNA, 23 nt, synthetic construct
  source 1..23: mol_type = other RNA; note = Description of Artificial Sequence: Synthetic oligonucleotide
ttagttctcgttccagtcgtctt

SEQ ID NO: 551 - RNA, 23 nt, synthetic construct
  source 1..23: mol_type = other RNA; note = Description of Artificial Sequence: Synthetic oligonucleotide
tatccactattccttggctagag

SEQ ID NO: 552 - RNA, 23 nt, synthetic construct
  source 1..23: mol_type = other RNA; note = Description of Artificial Sequence: Synthetic oligonucleotide
tgcatcactgtggtacagttttt

SEQ ID NO: 553 - RNA, 23 nt, synthetic construct
  source 1..23: mol_type = other RNA; note = Description of Artificial Sequence: Synthetic oligonucleotide
tgaagaacaggcatcactgtggt

SEQ ID NO: 554 - RNA, 23 nt, synthetic construct
  source 1..23: mol_type = other RNA; note = Description of Artificial Sequence: Synthetic oligonucleotide
tatcagcgcaatgtcattgttct

SEQ ID NO: 555 - RNA, 23 nt, synthetic construct
  source 1..23: mol_type = other RNA; note = Description of Artificial Sequence: Synthetic oligonucleotide
ttcatcagcgcaatgtcattgtt

SEQ ID NO: 556 - RNA, 23 nt, synthetic construct
  source 1..23: mol_type = other RNA; note = Description of Artificial Sequence: Synthetic oligonucleotide
tccaaaacaaaacacatctttct

SEQ ID NO: 557 - RNA, 23 nt, synthetic construct
  source 1..23: mol_type = other RNA; note = Description of Artificial Sequence: Synthetic oligonucleotide
tcatggttatggcacttggcaat

SEQ ID NO: 558 - RNA, 23 nt, synthetic construct
  source 1..23: mol_type = other RNA; note = Description of Artificial Sequence: Synthetic oligonucleotide
tcttagtctttgaggtgcacact

SEQ ID NO: 559 - RNA, 23 nt, synthetic construct
  source 1..23: mol_type = other RNA; note = Description of Artificial Sequence: Synthetic oligonucleotide
tgcacagtgctttcttagtcttt

SEQ ID NO: 560 - RNA, 23 nt, synthetic construct
  source 1..23: mol_type = other RNA; note = Description of Artificial Sequence: Synthetic oligonucleotide
tcctctgagatgagtacacctga

SEQ ID NO: 561 - RNA, 23 nt, synthetic construct
  source 1..23: mol_type = other RNA; note = Description of Artificial Sequence: Synthetic oligonucleotide
taagaacaggcatcactgtggta

SEQ ID NO: 562 - RNA, 23 nt, synthetic construct
  source 1..23: mol_type = other RNA; note = Description of Artificial Sequence: Synthetic oligonucleotide
ttgaagaacaggcatcactgtgg

SEQ ID NO: 563 - RNA, 23 nt, synthetic construct
  source 1..23: mol_type = other RNA; note = Description of Artificial Sequence: Synthetic oligonucleotide
taccactgcttttgaagaacagg

SEQ ID NO: 564 - RNA, 23 nt, synthetic construct
  source 1..23: mol_type = other RNA; note = Description of Artificial Sequence: Synthetic oligonucleotide
tcagcgcaatgtcattgttcttg

SEQ ID NO: 565 - RNA, 23 nt, synthetic construct
  source 1..23: mol_type = other RNA; note = Description of Artificial Sequence: Synthetic oligonucleotide
tcctgagttcaaagccatcttgc

SEQ ID NO: 566 - RNA, 23 nt, synthetic construct
  source 1..23: mol_type = other RNA; note = Description of Artificial Sequence: Synthetic oligonucleotide
taccctgagttcaaagccatctt

SEQ ID NO: 567 - RNA, 23 nt, synthetic construct
  source 1..23: mol_type = other RNA; note = Description of Artificial Sequence: Synthetic oligonucleotide
tcacagaatggcagagagtgcca

SEQ ID NO: 568 - RNA, 23 nt, synthetic construct
  source 1..23: mol_type = other RNA; note = Description of Artificial Sequence: Synthetic oligonucleotide
tcaagtgactaccacgtcaccac

SEQ ID NO: 569 - RNA, 23 nt, synthetic construct
  source 1..23: mol_type = other RNA; note = Description of Artificial Sequence: Synthetic oligonucleotide
tacaagtgactaccacgtcacca

SEQ ID NO: 570 - RNA, 23 nt, synthetic construct
  source 1..23: mol_type = other RNA; note = Description of Artificial Sequence: Synthetic oligonucleotide
tcctcaatttccagtgactagca

SEQ ID NO: 571 - RNA, 23 nt, synthetic construct
  source 1..23: mol_type = other RNA; note = Description of Artificial Sequence: Synthetic oligonucleotide
tcatggacctcaatttccagtga

SEQ ID NO: 572 - RNA, 23 nt, synthetic construct
  source 1..23: mol_type = other RNA; note = Description of Artificial Sequence: Synthetic oligonucleotide
tcaaaacacatctttctcttctt

SEQ ID NO: 573 - RNA, 23 nt, synthetic construct
  source 1..23: mol_type = other RNA; note = Description of Artificial Sequence: Synthetic oligonucleotide
taaacaaaacacatctttctctt

SEQ ID NO: 574 - RNA, 23 nt, synthetic construct
  source 1..23: mol_type = other RNA; note = Description of Artificial Sequence: Synthetic oligonucleotide
ttccaaaacaaaacacatctttc

SEQ ID NO: 575 - RNA, 23 nt, synthetic construct
  source 1..23: mol_type = other RNA; note = Description of Artificial Sequence: Synthetic oligonucleotide
tccacagagagtccaaaacaaaa

SEQ ID NO: 576 - RNA, 23 nt, synthetic construct
  source 1..23: mol_type = other RNA; note = Description of Artificial Sequence: Synthetic oligonucleotide
tcttcctctgagatgagtacacc

SEQ ID NO: 577 - RNA, 23 nt, synthetic construct
  source 1..23: mol_type = other RNA; note = Description of Artificial Sequence: Synthetic oligonucleotide
tcgcaatgtcattgttcttggtc

SEQ ID NO: 578 - RNA, 23 nt, synthetic construct
  source 1..23: mol_type = other RNA; note = Description of Artificial Sequence: Synthetic oligonucleotide
ttcagcgcaatgtcattgttctt

SEQ ID NO: 579 - RNA, 23 nt, synthetic construct
  source 1..23: mol_type = other RNA; note = Description of Artificial Sequence: Synthetic oligonucleotide
tgcttcatcagcgcaatgtcatt

SEQ ID NO: 580 - RNA, 23 nt, synthetic construct
  source 1..23: mol_type = other RNA; note = Description of Artificial Sequence: Synthetic oligonucleotide
tctgaggtcttccctttctcctc

SEQ ID NO: 581 - RNA, 23 nt, synthetic construct
  source 1..23: mol_type = other RNA; note = Description of Artificial Sequence: Synthetic oligonucleotide
tagaatggcagagagtgccaaag

SEQ ID NO: 582 - RNA, 23 nt, synthetic construct
  source 1..23: mol_type = other RNA; note = Description of Artificial Sequence: Synthetic oligonucleotide
tacacatctttctcttcttcgcc

SEQ ID NO: 583 - RNA, 23 nt, synthetic construct
  source 1..23: mol_type = other RNA; note = Description of Artificial Sequence: Synthetic oligonucleotide
tacaaaacacatctttctcttct

SEQ ID NO: 584 - RNA, 23 nt, synthetic construct
  source 1..23: mol_type = other RNA; note = Description of Artificial Sequence: Synthetic oligonucleotide
ttcattcttgcaaaccagcctgc

SEQ ID NO: 585 - RNA, 23 nt, synthetic construct
  source 1..23: mol_type = other RNA; note = Description of Artificial Sequence: Synthetic oligonucleotide
tatcctgcaaatgggattgcatg

SEQ ID NO: 586 - RNA, 23 nt, synthetic construct
  source 1..23: mol_type = other RNA; note = Description of Artificial Sequence: Synthetic oligonucleotide
tgatcctgcaaatgggattgcat

SEQ ID NO: 587 - RNA, 23 nt, synthetic construct
  source 1..23: mol_type = other RNA; note = Description of Artificial Sequence: Synthetic oligonucleotide
tctgctctctacagaggcatgtg

SEQ ID NO: 588 - RNA, 23 nt, synthetic construct
  source 1..23: mol_type = other RNA; note = Description of Artificial Sequence: Synthetic oligonucleotide
tgagtcgcactctatcccagagt

SEQ ID NO: 589 - RNA, 23 nt, synthetic construct
  source 1..23: mol_type = other RNA; note = Description of Artificial Sequence: Synthetic oligonucleotide
tggacttcctctgagatgagtac

SEQ ID NO: 590 - RNA, 23 nt, synthetic construct
  source 1..23: mol_type = other RNA; note = Description of Artificial Sequence: Synthetic oligonucleotide
tgtagttctcgttccagtcgtct

SEQ ID NO: 591 - RNA, 23 nt, synthetic construct
  source 1..23: mol_type = other RNA; note = Description of Artificial Sequence: Synthetic oligonucleotide
tttccttggctagagtaaaaatt

SEQ ID NO: 592 - RNA, 23 nt, synthetic construct
  source 1..23: mol_type = other RNA; note = Description of Artificial Sequence: Synthetic oligonucleotide
tctattccttggctagagtaaaa

SEQ ID NO: 593 - RNA, 23 nt, synthetic construct
  source 1..23: mol_type = other RNA; note = Description of Artificial Sequence: Synthetic oligonucleotide
taggcatcactgtggtacagttt

SEQ ID NO: 594 - RNA, 23 nt, synthetic construct
  source 1..23: mol_type = other RNA; note = Description of Artificial Sequence: Synthetic oligonucleotide
tagaacaggcatcactgtggtac

SEQ ID NO: 595 - RNA, 23 nt, synthetic construct
  source 1..23: mol_type = other RNA; note = Description of Artificial Sequence: Synthetic oligonucleotide
tcatcagcgcaatgtcattgttc

SEQ ID NO: 596 - RNA, 23 nt, synthetic construct
  source 1..23: mol_type = other RNA; note = Description of Artificial Sequence: Synthetic oligonucleotide
tcttcatcagcgcaatgtcattg

SEQ ID NO: 597 - RNA, 23 nt, synthetic construct
  source 1..23: mol_type = other RNA; note = Description of Artificial Sequence: Synthetic oligonucleotide
tacattcccgtacactcctggtc

SEQ ID NO: 598 - RNA, 23 nt, synthetic construct
  source 1..23: mol_type = other RNA; note = Description of Artificial Sequence: Synthetic oligonucleotide
tataaatccagtccgtgaatacc

SEQ ID NO: 599 - RNA, 23 nt, synthetic construct
  source 1..23: mol_type = other RNA; note = Description of Artificial Sequence: Synthetic oligonucleotide
tccctcatttgtcgataaatcca

SEQ ID NO: 600 - RNA, 23 nt, synthetic construct
  source 1..23: mol_type = other RNA; note = Description of Artificial Sequence: Synthetic oligonucleotide
tgtgacctctgaatcatctctaa

SEQ ID NO: 601 - RNA, 23 nt, synthetic construct
  source 1..23: mol_type = other RNA; note = Description of Artificial Sequence: Synthetic oligonucleotide
taacaaaacacatctttctcttc

SEQ ID NO: 602 - RNA, 23 nt, synthetic construct
  source 1..23: mol_type = other RNA; note = Description of Artificial Sequence: Synthetic oligonucleotide
tgctcatggttatggcacttggc

SEQ ID NO: 603 - RNA, 23 nt, synthetic construct
  source 1..23: mol_type = other RNA; note = Description of Artificial Sequence: Synthetic oligonucleotide
tgagtagtgctcatggttatggc

SEQ ID NO: 604 - RNA, 23 nt, synthetic construct
  source 1..23: mol_type = other RNA; note = Description of Artificial Sequence: Synthetic oligonucleotide
tacagacagatcctgcaaatggg

SEQ ID NO: 605 - RNA, 23 nt, synthetic construct
  source 1..23: mol_type = other RNA; note = Description of Artificial Sequence: Synthetic oligonucleotide
tcaggacttcctctgagatgagt

SEQ ID NO: 606 - RNA, 23 nt, synthetic construct
  source 1..23: mol_type = other RNA; note = Description of Artificial Sequence: Synthetic oligonucleotide
tcacattcccgtacactcctggt

SEQ ID NO: 607 - RNA, 23 nt, synthetic construct
  source 1..23: mol_type = other RNA; note = Description of Artificial Sequence: Synthetic oligonucleotide
tcagagagtgccaaagccagaca

SEQ ID NO: 608 - RNA, 23 nt, synthetic construct
  source 1..23: mol_type = other RNA; note = Description of Artificial Sequence: Synthetic oligonucleotide
tcagaatggcagagagtgccaaa

SEQ ID NO: 609 - RNA, 23 nt, synthetic construct
  source 1..23: mol_type = other RNA; note = Description of Artificial Sequence: Synthetic oligonucleotide
tacagaatggcagagagtgccaa

SEQ ID NO: 610 - RNA, 23 nt, synthetic construct
  source 1..23: mol_type = other RNA; note = Description of Artificial Sequence: Synthetic oligonucleotide
tttccggttggtatccatggttt

SEQ ID NO: 611 - RNA, 23 nt, synthetic construct
  source 1..23: mol_type = other RNA; note = Description of Artificial Sequence: Synthetic oligonucleotide
ttttccggttggtatccatggtt

SEQ ID NO: 612 - RNA, 23 nt, synthetic construct
  source 1..23: mol_type = other RNA; note = Description of Artificial Sequence: Synthetic oligonucleotide
tctgagcatccttgatttccccc

SEQ ID NO: 613 - RNA, 23 nt, synthetic construct
  source 1..23: mol_type = other RNA; note = Description of Artificial Sequence: Synthetic oligonucleotide
tctcatggttatggcacttggca

SEQ ID NO: 614 - RNA, 23 nt, synthetic construct
  source 1..23: mol_type = other RNA; note = Description of Artificial Sequence: Synthetic oligonucleotide
tcctgcaaatgggattgcatgac

SEQ ID NO: 615 - RNA, 23 nt, synthetic construct
  source 1..23: mol_type = other RNA; note = Description of Artificial Sequence: Synthetic oligonucleotide
tcagacagatcctgcaaatggga

SEQ ID NO: 616 - RNA, 23 nt, synthetic construct
  source 1..23: mol_type = other RNA; note = Description of Artificial Sequence: Synthetic oligonucleotide
tgtgcacagacagatcctgcaaa

SEQ ID NO: 617 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
ttcatttaactctttgaaaca

SEQ ID NO: 618 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aaacgtcttccttctttatta

SEQ ID NO: 619 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aacgtcttccttctttattga

SEQ ID NO: 620 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-hexadecyl-cytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tggtgaaaacgtcttccttca

SEQ ID NO: 621 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tggtttctttacgctgtataa

SEQ ID NO: 622 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-hexadecyl-cytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
ttccagatacctatcattaca

SEQ ID NO: 623 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tccagatacctatcattacta

SEQ ID NO: 624 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
cagatacctatcattactcga

SEQ ID NO: 625 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gatacctatcattactcgata

SEQ ID NO: 626 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
cgtggaaaaacctcttaacaa

SEQ ID NO: 627 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agtgatttctcatccaaatta

SEQ ID NO: 628 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tctcatccaaattatgactca

SEQ ID NO: 629 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-hexadecyl-cytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
atccaaattatgactccaaga

SEQ ID NO: 630 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
actggatttatcgacaaatga

SEQ ID NO: 631 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tttgatgtctccaagtagtca

SEQ ID NO: 632 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
caagacacatcctaaaaggta

SEQ ID NO: 633 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
gtaatggtgaaaacgtcttca

SEQ ID NO: 634 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tgaaaacgtcttccttcttta

SEQ ID NO: 635 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gaaaacgtcttccttctttaa

SEQ ID NO: 636 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aactgtaaagttcaattgtga

SEQ ID NO: 637 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gtactcatctcagaggaagta

SEQ ID NO: 638 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
cggcaatgtcgatatctataa

SEQ ID NO: 639 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ggcaatgtcgatatctataaa

SEQ ID NO: 640 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gcaatgtcgatatctataaaa

SEQ ID NO: 641 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
caatgtcgatatctataaaaa

SEQ ID NO: 642 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gtggtttctttacgctgtata

SEQ ID NO: 643 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
attccagatacctatcattaa

SEQ ID NO: 644 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
ccagatacctatcattactca

SEQ ID NO: 645 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
agatacctatcattactcgaa

SEQ ID NO: 646 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gtgatttctcatccaaattaa

SEQ ID NO: 647 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tgatttctcatccaaattata

SEQ ID NO: 648 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
atttctcatccaaattatgaa

SEQ ID NO: 649 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tttctcatccaaattatgaca

SEQ ID NO: 650 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttctcatccaaattatgacta

SEQ ID NO: 651 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
aggtcacttcatttttattaa

SEQ ID NO: 652 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
atgtttctacacattgctaca

SEQ ID NO: 653 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tcatttaactctttgaaacta

SEQ ID NO: 654 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ctaggacttaaccttgaaata

SEQ ID NO: 655 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agacacatcctaaaaggtgta

SEQ ID NO: 656 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gacacatcctaaaaggtgtta

SEQ ID NO: 657 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
atggtgaaaacgtcttcctta

SEQ ID NO: 658 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gtgaaaacgtcttccttctta

SEQ ID NO: 659 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aaaacgtcttccttctttata

SEQ ID NO: 660 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
atgcctgttcttcaaaagcaa

SEQ ID NO: 661 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gcctgttcttcaaaagcagta

SEQ ID NO: 662 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttcaaaagcagtggtttctta

SEQ ID NO: 663 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ctatcattactcgatgctgta

SEQ ID NO: 664 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgcgtggaaaaacctcttaaa

SEQ ID NO: 665 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
caagtagaaaaagtgatttca

SEQ ID NO: 666 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aagtagaaaaagtgatttcta

SEQ ID NO: 667 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gtagaaaaagtgatttctcaa

SEQ ID NO: 668 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-hexadecyl-cytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tagaaaaagtgatttctcata

SEQ ID NO: 669 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
aaaagtgatttctcatccaaa

SEQ ID NO: 670 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gatttctcatccaaattatga

SEQ ID NO: 671 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
aagcctctgactttcaacgaa

SEQ ID NO: 672 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gctagtcactggaaattgaga

SEQ ID NO: 673 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttttgatgtctccaagtagta

SEQ ID NO: 674 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gatgtgttttgttttggacta

SEQ ID NO: 675 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttttgttttggactctctgta

SEQ ID NO: 676 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gctggtttgcaagaatgaaaa

SEQ ID NO: 677 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tggtttgcaagaatgaaatga

SEQ ID NO: 678 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ggtttgcaagaatgaaatgaa

SEQ ID NO: 679 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
taggacttaaccttgaaatga

SEQ ID NO: 680 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-hexadecyl-cytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ggtgaaaacgtcttccttcta

SEQ ID NO: 681 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
acgtcttccttctttattgca

SEQ ID NO: 682 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
cgtcttccttctttattgcca

SEQ ID NO: 683 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-hexadecyl-uridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ctgtaaagttcaattgtgaaa

SEQ ID NO: 684 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gcacctcaaagactaagaaaa

SEQ ID NO: 685 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
cacctcaaagactaagaaaga

SEQ ID NO: 686 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
atccaccagctttatgaaaca

SEQ ID NO: 687 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tgatgcctgttcttcaaaaga

SEQ ID NO: 688 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
gatgcctgttcttcaaaagca

SEQ ID NO: 689 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tgcctgttcttcaaaagcaga

SEQ ID NO: 690 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tcttcaaaagcagtggtttca

SEQ ID NO: 691 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
cattccagatacctatcatta

SEQ ID NO: 692 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
acctatcattactcgatgcta

SEQ ID NO: 693 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
gcgtggaaaaacctcttaaca

SEQ ID NO: 694 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
cattactcgatgctgttgata

SEQ ID NO: 695 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ttactcgatgctgttgataaa

SEQ ID NO: 696 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aagaacaatgacattgcgcta

SEQ ID NO: 697 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
acagcaagatggctttgaaca

SEQ ID NO: 698 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-hexadecyl-uridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
cagcaagatggctttgaacta

SEQ ID NO: 699 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tcagaggtcacttcattttta

SEQ ID NO: 700 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
cagaggtcacttcatttttaa

SEQ ID NO: 701 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tgttatgtttctacacattga

SEQ ID NO: 702 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tatgtttctacacattgctaa

SEQ ID NO: 703 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
acgttctataaatgaatgtga

SEQ ID NO: 704 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gttttgttttggactctctga

SEQ ID NO: 705 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gtttgcaagaatgaaatgaaa

SEQ ID NO: 706 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
aagaatgaaatgaatgattca

SEQ ID NO: 707 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gctaggacttaaccttgaaaa

SEQ ID NO: 708 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aagacacatcctaaaaggtga

SEQ ID NO: 709 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tgtaatggtgaaaacgtctta

SEQ ID NO: 710 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aatggtgaaaacgtcttccta

SEQ ID NO: 711 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
actgtaaagttcaattgtgaa

SEQ ID NO: 712 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-hexadecyl-uridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgtaaagttcaattgtgaaaa

SEQ ID NO: 713 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
acctcaaagactaagaaagca

SEQ ID NO: 714 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-hexadecyl-cytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
cctcaaagactaagaaagcaa

SEQ ID NO: 715 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-hexadecyl-cytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
ctcaaagactaagaaagcaca

SEQ ID NO: 716 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
caccagctttatgaaactgaa

SEQ ID NO: 717 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ccggcaatgtcgatatctata

SEQ ID NO: 718 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gttcttcaaaagcagtggtta

SEQ ID NO: 719 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
cttcaaaagcagtggtttcta

SEQ ID NO: 720 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ttgaacattccagatacctaa

SEQ ID NO: 721 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
acattccagatacctatcata

SEQ ID NO: 722 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tcattactcgatgctgttgaa

SEQ ID NO: 723 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agtagaaaaagtgatttctca

SEQ ID NO: 724 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-cytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ctccaagaccaagaacaatga

SEQ ID NO: 725 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
caagaccaagaacaatgacaa

SEQ ID NO: 726 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
caagatggctttgaactcaga

SEQ ID NO: 727 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gacgtggtagtcacttgtaaa

SEQ ID NO: 728 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
gttatgtttctacacattgca

SEQ ID NO: 729 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tttgcaagaatgaaatgaata

SEQ ID NO: 730 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aggacttaaccttgaaatgga

SEQ ID NO: 731 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-hexadecyl-cytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tgtgaaaatgaatatcatgca

SEQ ID NO: 732 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
agtgatgcctgttcttcaaaa

SEQ ID NO: 733 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttcttcaaaagcagtggttta

SEQ ID NO: 734 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tcaaaagcagtggtttcttta

SEQ ID NO: 735 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
caaaagcagtggtttctttaa

SEQ ID NO: 736 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ggtttctttacgctgtataga

SEQ ID NO: 737 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
atacctatcattactcgatga

SEQ ID NO: 738 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
atcattactcgatgctgttga

SEQ ID NO: 739 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
aaaaagtgatttctcatccaa

SEQ ID NO: 740 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
actccaagaccaagaacaata

SEQ ID NO: 741 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
ccaagaccaagaacaatgaca

SEQ ID NO: 742 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aagaccaagaacaatgacata

SEQ ID NO: 743 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ctggatttatcgacaaatgaa

SEQ ID NO: 744 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-hexadecyl-cytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttcagaggtcacttcatttta

SEQ ID NO: 745 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agaggtcacttcatttttata

SEQ ID NO: 746 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gaggtcacttcatttttatta

SEQ ID NO: 747 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ggaacagaaacatttttgtta

SEQ ID NO: 748 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgctagtcactggaaattgaa

SEQ ID NO: 749 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttatgtttctacacattgcta

SEQ ID NO: 750 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
cttttgatgtctccaagtaga

SEQ ID NO: 751 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgatgtctccaagtagtccaa

SEQ ID NO: 752 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ttctataaatgaatgtgctga

SEQ ID NO: 753 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agaatgaaatgaatgattcta

SEQ ID NO: 754 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
aatgaaatgaatgattctaca

SEQ ID NO: 755 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ggacttaaccttgaaatggaa

SEQ ID NO: 756 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-hexadecyl-uridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gacttaaccttgaaatggaaa

SEQ ID NO: 757 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agtcatgcaatcccatttgca

SEQ ID NO: 758 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gtcatgcaatcccatttgcaa

SEQ ID NO: 759 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gtgcacctcaaagactaagaa

SEQ ID NO: 760 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tccaccagctttatgaaacta

SEQ ID NO: 761 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agctttatgaaactgaacaca

SEQ ID NO: 762 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
atgaaactgaacacaagtgca

SEQ ID NO: 763 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
attgaacattccagataccta

SEQ ID NO: 764 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
aaaagcagtggtttctttaca

SEQ ID NO: 765 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
gtttctttacgctgtatagca

SEQ ID NO: 766 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
attactcgatgctgttgataa

SEQ ID NO: 767 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-hexadecyl-cytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gaccaagaacaatgacattga

SEQ ID NO: 768 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-hexadecyl-cytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
accaagaacaatgacattgca

SEQ ID NO: 769 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-hexadecyl-cytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agcaagatggctttgaactca

SEQ ID NO: 770 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
cacggactggatttatcgaca

SEQ ID NO: 771 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
acggactggatttatcgacaa

SEQ ID NO: 772 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tggatttatcgacaaatgaga

SEQ ID NO: 773 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
acgtggtagtcacttgtaaga

SEQ ID NO: 774 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tagtcactggaaattgaggta

SEQ ID NO: 775 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aaatcaaggatgctcagttta

SEQ ID NO: 776 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-hexadecyl-uridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tctataaatgaatgtgctgaa

SEQ ID NO: 777 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tataaatgaatgtgctgaaga

SEQ ID NO: 778 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tttgttttggactctctgtga

SEQ ID NO: 779 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ggctggtttgcaagaatgaaa

SEQ ID NO: 780 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
agctaggacttaaccttgaaa

SEQ ID NO: 781 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tcccatttgcaggatctgtca

SEQ ID NO: 782 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aaagttcaattgtgaaaatga

SEQ ID NO: 783 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgcacctcaaagactaagaaa

SEQ ID NO: 784 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aaagactaagaaagcactgta

SEQ ID NO: 785 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
caggtgtactcatctcagaga

SEQ ID NO: 786 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-hexadecyl-uridine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
actctagccaaggaatagtga

SEQ ID NO: 787 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
cagtgatgcctgttcttcaaa

SEQ ID NO: 788 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aaagcagtggtttctttacga

SEQ ID NO: 789 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gcagtggtttctttacgctga

SEQ ID NO: 790 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
cagtggtttctttacgctgta

SEQ ID NO: 791 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
cctatcattactcgatgctga

SEQ ID NO: 792 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
atgactccaagaccaagaaca

SEQ ID NO: 793 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-hexadecyl-cytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tccaagaccaagaacaatgaa

SEQ ID NO: 794 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-hexadecyl-cytidine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ttcacggactggatttatcga

SEQ ID NO: 795 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tgattcagaggtcacttcata

SEQ ID NO: 796 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gattcagaggtcacttcatta

SEQ ID NO: 797 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-hexadecyl-cytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
attcagaggtcacttcattta

SEQ ID NO: 798 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agtcactggaaattgaggtca

SEQ ID NO: 799 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gtttctacacattgctaccta

SEQ ID NO: 800 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tttctacacattgctacctca

SEQ ID NO: 801 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
ttgatgtctccaagtagtcca

SEQ ID NO: 802 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gttctataaatgaatgtgcta

SEQ ID NO: 803 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tgttttggactctctgtggta

SEQ ID NO: 804 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
taaccatgagcactactctaa

SEQ ID NO: 805 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gcaggctggtttgcaagaata

SEQ ID NO: 806 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
caagaatgaaatgaatgatta

SEQ ID NO: 807 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aagactaagaaagcactgtga

SEQ ID NO: 808 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-hexadecyl-uridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
cttcaggtgtactcatctcaa

SEQ ID NO: 809 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ttcaggtgtactcatctcaga

SEQ ID NO: 810 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ccaccagctttatgaaactga

SEQ ID NO: 811 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
aagcagtggtttctttacgca

SEQ ID NO: 812 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agcagtggtttctttacgcta

SEQ ID NO: 813 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
caagaacaatgacattgcgca

SEQ ID NO: 814 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
cggactggatttatcgacaaa

SEQ ID NO: 815 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ggatttatcgacaaatgagga

SEQ ID NO: 816 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgacgtggtagtcacttgtaa

SEQ ID NO: 817 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
cgttctataaatgaatgtgca

SEQ ID NO: 818 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-hexadecyl-uridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agaaagatgtgttttgtttta

SEQ ID NO: 819 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gaaagatgtgttttgttttga

SEQ ID NO: 820 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agatgtgttttgttttggaca

SEQ ID NO: 821 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-hexadecyl-uridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ttgcaagaatgaaatgaatga

SEQ ID NO: 822 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-hexadecyl-uridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgcaagaatgaaatgaatgaa

SEQ ID NO: 823 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-hexadecyl-uridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gcaagaatgaaatgaatgata

SEQ ID NO: 824 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aagtcatgcaatcccatttga

SEQ ID NO: 825 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
atcccatttgcaggatctgta

SEQ ID NO: 826 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tctgtagagagcagcattcca

SEQ ID NO: 827 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
taatggtgaaaacgtcttcca

SEQ ID NO: 828 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-hexadecyl-uridine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gtgaaaatgaatatcatgcaa

SEQ ID NO: 829 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tgaaaatgaatatcatgcaaa

SEQ ID NO: 830 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
ccttcaggtgtactcatctca

SEQ ID NO: 831 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
cgactggaacgagaactacga

SEQ ID NO: 832 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gggacatgggctataagaata

SEQ ID NO: 833 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttttactctagccaaggaata

SEQ ID NO: 834 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tactctagccaaggaatagta

SEQ ID NO: 835 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-hexadecyl-cytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tatgaaactgaacacaagtga

SEQ ID NO: 836 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tacctatcattactcgatgca

SEQ ID NO: 837 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
attcacggactggatttatca

SEQ ID NO: 838 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-hexadecyl-uridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tcacggactggatttatcgaa

SEQ ID NO: 839 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-hexadecyl-uridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
atgaaaaccatggataccaaa

SEQ ID NO: 840 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
cgtggtagtcacttgtaagga

SEQ ID NO: 841 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-hexadecyl-uridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gcgaagaagagaaagatgtga

SEQ ID NO: 842 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-hexadecyl-uridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gaagaagagaaagatgtgtta

SEQ ID NO: 843 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-hexadecyl-uridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aagaagagaaagatgtgttta

SEQ ID NO: 844 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-hexadecyl-uridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agaagagaaagatgtgtttta

SEQ ID NO: 845 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ataaccatgagcactactcta

SEQ ID NO: 846 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
caggctggtttgcaagaatga

SEQ ID NO: 847 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tcatgcaatcccatttgcaga

SEQ ID NO: 848 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
cccatttgcaggatctgtcta

SEQ ID NO: 849 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ctcatctcagaggaagtccta

SEQ ID NO: 850 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gacgactggaacgagaactaa

SEQ ID NO: 851 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ctagccaaggaatagtggata

SEQ ID NO: 852 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
aaactgtaccacagtgatgca

SEQ ID NO: 853 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
cacagtgatgcctgttcttca

SEQ ID NO: 854 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aacaatgacattgcgctgata

SEQ ID NO: 855 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
caatgacattgcgctgatgaa

SEQ ID NO: 856 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aaagatgtgttttgttttgga

SEQ ID NO: 857 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-cytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tgccaagtgccataaccatga

SEQ ID NO: 858 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tgtgcacctcaaagactaaga

SEQ ID NO: 859 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-hexadecyl-uridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agactaagaaagcactgtgca

SEQ ID NO: 860 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aggtgtactcatctcagagga

SEQ ID NO: 861 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ccacagtgatgcctgttctta

SEQ ID NO: 862 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
acagtgatgcctgttcttcaa

SEQ ID NO: 863 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tgttcttcaaaagcagtggta

SEQ ID NO: 864 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
agaacaatgacattgcgctga

SEQ ID NO: 865 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
aagatggctttgaactcagga

SEQ ID NO: 866 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gatggctttgaactcagggta

SEQ ID NO: 867 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gcactctctgccattctgtga

SEQ ID NO: 868 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ggtgacgtggtagtcacttga

SEQ ID NO: 869 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gtgacgtggtagtcacttgta

SEQ ID NO: 870 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ctagtcactggaaattgagga

SEQ ID NO: 871 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-hexadecyl-cytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
actggaaattgaggtccatga

SEQ ID NO: 872 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gaagagaaagatgtgttttga

SEQ ID NO: 873 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
gagaaagatgtgttttgttta

SEQ ID NO: 874 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
aagatgtgttttgttttggaa

SEQ ID NO: 875 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ttgttttggactctctgtgga

SEQ ID NO: 876 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tgtactcatctcagaggaaga

SEQ ID NO: 877 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ccaagaacaatgacattgcga

SEQ ID NO: 878 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
gaacaatgacattgcgctgaa

SEQ ID NO: 879 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tgacattgcgctgatgaagca

SEQ ID NO: 880 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-hexadecyl-cytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ggagaaagggaagacctcaga

SEQ ID NO: 881 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ttggcactctctgccattcta

SEQ ID NO: 882 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-hexadecyl-uridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
cgaagaagagaaagatgtgta

SEQ ID NO: 883 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
aagagaaagatgtgttttgta

SEQ ID NO: 884 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
aggctggtttgcaagaatgaa

SEQ ID NO: 885 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tgcaatcccatttgcaggata

SEQ ID NO: 886 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
gcaatcccatttgcaggatca

SEQ ID NO: 887 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
catgcctctgtagagagcaga

SEQ ID NO: 888 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-hexadecyl-cytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tctgggatagagtgcgactca

SEQ ID NO: 889 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
actcatctcagaggaagtcca

SEQ ID NO: 890 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
acgactggaacgagaactaca

SEQ ID NO: 891 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
tttttactctagccaaggaaa

SEQ ID NO: 892 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ttactctagccaaggaataga

SEQ ID NO: 893 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
actgtaccacagtgatgccta

SEQ ID NO: 894 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
accacagtgatgcctgttcta

SEQ ID NO: 895 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
acaatgacattgcgctgatga

SEQ ID NO: 896 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
atgacattgcgctgatgaaga

SEQ ID NO: 897 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-hexadecyl-uridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ccaggagtgtacgggaatgta

SEQ ID NO: 898 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-hexadecyl-cytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
tattcacggactggatttata

SEQ ID NO: 899 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gatttatcgacaaatgaggga

SEQ ID NO: 900 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
agagatgattcagaggtcaca

SEQ ID NO: 901 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-hexadecyl-uridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
agagaaagatgtgttttgtta

SEQ ID NO: 902 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
caagtgccataaccatgagca

SEQ ID NO: 903 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
cataaccatgagcactactca

SEQ ID NO: 904 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
catttgcaggatctgtctgta

SEQ ID NO: 905 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tcatctcagaggaagtcctga

SEQ ID NO: 906 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
caggagtgtacgggaatgtga

SEQ ID NO: 907 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tctggctttggcactctctga

SEQ ID NO: 908 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
tggcactctctgccattctga

SEQ ID NO: 909 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
ggcactctctgccattctgta

SEQ ID NO: 910 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
accatggataccaaccggaaa

SEQ ID NO: 911 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-hexadecyl-cytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyladenosine-3'- phosphorothioate
  modified_base 21: mod_base = OTHER; note = 2'-O-methyladenosine-3'-phosphate
ccatggataccaaccggaaaa

SEQ ID NO: 912 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
gggaaatcaaggatgctcaga

SEQ ID NO: 913 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ccaagtgccataaccatgaga

SEQ ID NO: 914 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-hexadecyl-cytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
catgcaatcccatttgcagga

SEQ ID NO: 915 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methyladenosine-3'-phosphate
ccatttgcaggatctgtctga

SEQ ID NO: 916 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-hexadecyl-uridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methyladenosine-3'-phosphate
tgcaggatctgtctgtgcaca

SEQ ID NO: 917 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tgtttcaaagagttaaatgaagg

SEQ ID NO: 918 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
taataaagaaggaagacgttttc

SEQ ID NO: 919 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tcaataaagaaggaagacgtttt

SEQ ID NO: 920 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgaaggaagacgttttcaccatt

SEQ ID NO: 921 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
ttatacagcgtaaagaaaccact

SEQ ID NO: 922 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tgtaatgataggtatctggaatg

SEQ ID NO: 923 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tagtaatgataggtatctggaat

SEQ ID NO: 924 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tcgagtaatgataggtatctgga

SEQ ID NO: 925 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tatcgagtaatgataggtatctg

SEQ ID NO: 926 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
ttgttaagaggtttttccacgca

SEQ ID NO: 927 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
taatttggatgagaaatcacttt

SEQ ID NO: 928 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgagtcataatttggatgagaaa

SEQ ID NO: 929 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tcttggagtcataatttggatga

SEQ ID NO: 930 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tcatttgtcgataaatccagtcc

SEQ ID NO: 931 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tgactacttggagacatcaaaag

SEQ ID NO: 932 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
taccttttaggatgtgtcttggg

SEQ ID NO: 933 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgaagacgttttcaccattacaa

SEQ ID NO: 934 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
taaagaaggaagacgttttcacc

SEQ ID NO: 935 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
ttaaagaaggaagacgttttcac

SEQ ID NO: 936 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
tcacaattgaactttacagttta

SEQ ID NO: 937 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tacttcctctgagatgagtacac

SEQ ID NO: 938 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
ttatagatatcgacattgccggc

SEQ ID NO: 939 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tttatagatatcgacattgccgg

SEQ ID NO: 940 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
ttttatagatatcgacattgccg

SEQ ID NO: 941 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tttttatagatatcgacattgcc

SEQ ID NO: 942 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tatacagcgtaaagaaaccactg

SEQ ID NO: 943 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
ttaatgataggtatctggaatgt

SEQ ID NO: 944 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgagtaatgataggtatctggaa

SEQ ID NO: 945 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
ttcgagtaatgataggtatctgg

SEQ ID NO: 946 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttaatttggatgagaaatcactt

SEQ ID NO: 947 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tataatttggatgagaaatcact

SEQ ID NO: 948 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
ttcataatttggatgagaaatca

SEQ ID NO: 949 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tgtcataatttggatgagaaatc

SEQ ID NO: 950 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tagtcataatttggatgagaaat

SEQ ID NO: 951 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
ttaataaaaatgaagtgacctct

SEQ ID NO: 952 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgtagcaatgtgtagaaacataa

SEQ ID NO: 953 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tagtttcaaagagttaaatgaag

SEQ ID NO: 954 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tatttcaaggttaagtcctagct

SEQ ID NO: 955 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tacaccttttaggatgtgtcttg

SEQ ID NO: 956 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
taacaccttttaggatgtgtctt

SEQ ID NO: 957 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
taaggaagacgttttcaccatta

SEQ ID NO: 958 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
taagaaggaagacgttttcacca

SEQ ID NO: 959 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tataaagaaggaagacgttttca

SEQ ID NO: 960 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
ttgcttttgaagaacaggcatca

SEQ ID NO: 961 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tactgcttttgaagaacaggcat

SEQ ID NO: 962 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
taagaaaccactgcttttgaaga

SEQ ID NO: 963 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tacagcatcgagtaatgataggt

SEQ ID NO: 964 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tttaagaggtttttccacgcagt

SEQ ID NO: 965 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tgaaatcactttttctacttggt

SEQ ID NO: 966 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tagaaatcactttttctacttgg

SEQ ID NO: 967 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttgagaaatcactttttctactt

SEQ ID NO: 968 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tatgagaaatcactttttctact

SEQ ID NO: 969 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tttggatgagaaatcactttttc

SEQ ID NO: 970 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tcataatttggatgagaaatcac

SEQ ID NO: 971 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
ttcgttgaaagtcagaggcttct

SEQ ID NO: 972 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tctcaatttccagtgactagcag

SEQ ID NO: 973 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tactacttggagacatcaaaagc

SEQ ID NO: 974 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tagtccaaaacaaaacacatctt

SEQ ID NO: 975 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tacagagagtccaaaacaaaaca

SEQ ID NO: 976 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
ttttcattcttgcaaaccagcct

SEQ ID NO: 977 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tcatttcattcttgcaaaccagc

SEQ ID NO: 978 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
ttcatttcattcttgcaaaccag

SEQ ID NO: 979 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tcatttcaaggttaagtcctagc

SEQ ID NO: 980 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tagaaggaagacgttttcaccat

SEQ ID NO: 981 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgcaataaagaaggaagacgttt

SEQ ID NO: 982 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tggcaataaagaaggaagacgtt

SEQ ID NO: 983 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tttcacaattgaactttacagtt

SEQ ID NO: 984 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
ttttcttagtctttgaggtgcac

SEQ ID NO: 985 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tctttcttagtctttgaggtgca

SEQ ID NO: 986 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tgtttcataaagctggtggatcc

SEQ ID NO: 987 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tcttttgaagaacaggcatcact

SEQ ID NO: 988 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tgcttttgaagaacaggcatcac

SEQ ID NO: 989 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tctgcttttgaagaacaggcatc

SEQ ID NO: 990 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tgaaaccactgcttttgaagaac

SEQ ID NO: 991 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
taatgataggtatctggaatgtt

SEQ ID NO: 992 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tagcatcgagtaatgataggtat

SEQ ID NO: 993 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tgttaagaggtttttccacgcag

SEQ ID NO: 994 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tatcaacagcatcgagtaatgat

SEQ ID NO: 995 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tttatcaacagcatcgagtaatg

SEQ ID NO: 996 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tagcgcaatgtcattgttcttgg

SEQ ID NO: 997 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
tgttcaaagccatcttgctgtta

SEQ ID NO: 998 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tagttcaaagccatcttgctgtt

SEQ ID NO: 999 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
taaaaatgaagtgacctctgaat

SEQ ID NO: 1000 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
ttaaaaatgaagtgacctctgaa

SEQ ID NO: 1001 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tcaatgtgtagaaacataacatg

SEQ ID NO: 1002 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
ttagcaatgtgtagaaacataac

SEQ ID NO: 1003 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
tcacattcatttatagaacgtta

SEQ ID NO: 1004 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tcagagagtccaaaacaaaacac

SEQ ID NO: 1005 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tttcatttcattcttgcaaacca

SEQ ID NO: 1006 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tgaatcattcatttcattcttgc

SEQ ID NO: 1007 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
ttttcaaggttaagtcctagctg

SEQ ID NO: 1008 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tcaccttttaggatgtgtcttgg

SEQ ID NO: 1009 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
taagacgttttcaccattacaac

SEQ ID NO: 1010 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
taggaagacgttttcaccattac

SEQ ID NO: 1011 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttcacaattgaactttacagttt

SEQ ID NO: 1012 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
ttttcacaattgaactttacagt

SEQ ID NO: 1013 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tgctttcttagtctttgaggtgc

SEQ ID NO: 1014 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
ttgctttcttagtctttgaggtg

SEQ ID NO: 1015 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tgtgctttcttagtctttgaggt

SEQ ID NO: 1016 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
ttcagtttcataaagctggtgga

SEQ ID NO: 1017 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tatagatatcgacattgccggca

SEQ ID NO: 1018 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
taaccactgcttttgaagaacag

SEQ ID NO: 1019 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tagaaaccactgcttttgaagaa

SEQ ID NO: 1020 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
ttaggtatctggaatgttcaata

SEQ ID NO: 1021 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tatgataggtatctggaatgttc

SEQ ID NO: 1022 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
ttcaacagcatcgagtaatgata

SEQ ID NO: 1023 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tgagaaatcactttttctacttg

SEQ ID NO: 1024 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tcattgttcttggtcttggagtc

SEQ ID NO: 1025 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
ttgtcattgttcttggtcttgga

SEQ ID NO: 1026 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tctgagttcaaagccatcttgct

SEQ ID NO: 1027 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tttacaagtgactaccacgtcac

SEQ ID NO: 1028 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tgcaatgtgtagaaacataacat

SEQ ID NO: 1029 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tattcatttcattcttgcaaacc

SEQ ID NO: 1030 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tccatttcaaggttaagtcctag

SEQ ID NO: 1031 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tgcatgatattcattttcacaat

SEQ ID NO: 1032 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
ttttgaagaacaggcatcactgt

SEQ ID NO: 1033 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
taaaccactgcttttgaagaaca

SEQ ID NO: 1034 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
taaagaaaccactgcttttgaag

SEQ ID NO: 1035 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
ttaaagaaaccactgcttttgaa

SEQ ID NO: 1036 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tctatacagcgtaaagaaaccac

SEQ ID NO: 1037 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tcatcgagtaatgataggtatct

SEQ ID NO: 1038 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tcaacagcatcgagtaatgatag

SEQ ID NO: 1039 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
ttggatgagaaatcactttttct

SEQ ID NO: 1040 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tattgttcttggtcttggagtca

SEQ ID NO: 1041 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tgtcattgttcttggtcttggag

SEQ ID NO: 1042 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tatgtcattgttcttggtcttgg

SEQ ID NO: 1043 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
ttcatttgtcgataaatccagtc

SEQ ID NO: 1044 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
taaaatgaagtgacctctgaatc

SEQ ID NO: 1045 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tataaaaatgaagtgacctctga

SEQ ID NO: 1046 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
taataaaaatgaagtgacctctg

SEQ ID NO: 1047 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
taacaaaaatgtttctgttcccc

SEQ ID NO: 1048 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
ttcaatttccagtgactagcagg

SEQ ID NO: 1049 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tagcaatgtgtagaaacataaca

SEQ ID NO: 1050 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tctacttggagacatcaaaagct

SEQ ID NO: 1051 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
ttggactacttggagacatcaaa

SEQ ID NO: 1052 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
tcagcacattcatttatagaacg

SEQ ID NO: 1053 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tagaatcattcatttcattcttg

SEQ ID NO: 1054 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tgtagaatcattcatttcattct

SEQ ID NO: 1055 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
ttccatttcaaggttaagtccta

SEQ ID NO: 1056 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tttccatttcaaggttaagtcct

SEQ ID NO: 1057 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgcaaatgggattgcatgacttt

SEQ ID NO: 1058 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttgcaaatgggattgcatgactt

SEQ ID NO: 1059 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
ttcttagtctttgaggtgcacac

SEQ ID NO: 1060 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tagtttcataaagctggtggatc

SEQ ID NO: 1061 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tgtgttcagtttcataaagctgg

SEQ ID NO: 1062 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgcacttgtgttcagtttcataa

SEQ ID NO: 1063 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
taggtatctggaatgttcaatat

SEQ ID NO: 1064 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tgtaaagaaaccactgcttttga

SEQ ID NO: 1065 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tgctatacagcgtaaagaaacca

SEQ ID NO: 1066 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
ttatcaacagcatcgagtaatga

SEQ ID NO: 1067 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tcaatgtcattgttcttggtctt

SEQ ID NO: 1068 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tgcaatgtcattgttcttggtct

SEQ ID NO: 1069 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tgagttcaaagccatcttgctgt

SEQ ID NO: 1070 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgtcgataaatccagtccgtgaa

SEQ ID NO: 1071 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
ttgtcgataaatccagtccgtga

SEQ ID NO: 1072 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tctcatttgtcgataaatccagt

SEQ ID NO: 1073 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tcttacaagtgactaccacgtca

SEQ ID NO: 1074 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tacctcaatttccagtgactagc

SEQ ID NO: 1075 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
taaactgagcatccttgatttcc

SEQ ID NO: 1076 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
ttcagcacattcatttatagaac

SEQ ID NO: 1077 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tcttcagcacattcatttataga

SEQ ID NO: 1078 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tcacagagagtccaaaacaaaac

SEQ ID NO: 1079 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tttcattcttgcaaaccagcctg

SEQ ID NO: 1080 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tttcaaggttaagtcctagctgt

SEQ ID NO: 1081 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgacagatcctgcaaatgggatt

SEQ ID NO: 1082 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tcattttcacaattgaactttac

SEQ ID NO: 1083 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tttcttagtctttgaggtgcaca

SEQ ID NO: 1084 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tacagtgctttcttagtctttga

SEQ ID NO: 1085 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tctctgagatgagtacacctgaa

SEQ ID NO: 1086 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tcactattccttggctagagtaa

SEQ ID NO: 1087 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tttgaagaacaggcatcactgtg

SEQ ID NO: 1088 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tcgtaaagaaaccactgcttttg

SEQ ID NO: 1089 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tcagcgtaaagaaaccactgctt

SEQ ID NO: 1090 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tacagcgtaaagaaaccactgct

SEQ ID NO: 1091 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
tcagcatcgagtaatgataggta

SEQ ID NO: 1092 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgttcttggtcttggagtcataa

SEQ ID NO: 1093 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
ttcattgttcttggtcttggagt

SEQ ID NO: 1094 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
tcgataaatccagtccgtgaata

SEQ ID NO: 1095 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tatgaagtgacctctgaatcatc

SEQ ID NO: 1096 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
taatgaagtgacctctgaatcat

SEQ ID NO: 1097 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
taaatgaagtgacctctgaatca

SEQ ID NO: 1098 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tgacctcaatttccagtgactag

SEQ ID NO: 1099 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
taggtagcaatgtgtagaaacat

SEQ ID NO: 1100 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tgaggtagcaatgtgtagaaaca

SEQ ID NO: 1101 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tggactacttggagacatcaaaa

SEQ ID NO: 1102 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tagcacattcatttatagaacgt

SEQ ID NO: 1103 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
taccacagagagtccaaaacaaa

SEQ ID NO: 1104 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
ttagagtagtgctcatggttatg

SEQ ID NO: 1105 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tattcttgcaaaccagcctgctt

SEQ ID NO: 1106 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
taatcattcatttcattcttgca

SEQ ID NO: 1107 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tcacagtgctttcttagtctttg

SEQ ID NO: 1108 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
ttgagatgagtacacctgaagga

SEQ ID NO: 1109 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tctgagatgagtacacctgaagg

SEQ ID NO: 1110 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tcagtttcataaagctggtggat

SEQ ID NO: 1111 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgcgtaaagaaaccactgctttt

SEQ ID NO: 1112 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tagcgtaaagaaaccactgcttt

SEQ ID NO: 1113 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tgcgcaatgtcattgttcttggt

SEQ ID NO: 1114 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tttgtcgataaatccagtccgtg

SEQ ID NO: 1115 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tcctcatttgtcgataaatccag

SEQ ID NO: 1116 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
ttacaagtgactaccacgtcacc

SEQ ID NO: 1117 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgcacattcatttatagaacgtt

SEQ ID NO: 1118 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
taaaacaaaacacatctttctct

SEQ ID NO: 1119 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tcaaaacaaaacacatctttctc

SEQ ID NO: 1120 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgtccaaaacaaaacacatcttt

SEQ ID NO: 1121 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tcattcatttcattcttgcaaac

SEQ ID NO: 1122 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
ttcattcatttcattcttgcaaa

SEQ ID NO: 1123 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tatcattcatttcattcttgcaa

SEQ ID NO: 1124 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tcaaatgggattgcatgactttc

SEQ ID NO: 1125 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tacagatcctgcaaatgggattg

SEQ ID NO: 1126 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tggaatgctgctctctacagagg

SEQ ID NO: 1127 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tggaagacgttttcaccattaca

SEQ ID NO: 1128 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
ttgcatgatattcattttcacaa

SEQ ID NO: 1129 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tttgcatgatattcattttcaca

SEQ ID NO: 1130 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tgagatgagtacacctgaaggat

SEQ ID NO: 1131 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tcgtagttctcgttccagtcgtc

SEQ ID NO: 1132 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tattcttatagcccatgtccctg

SEQ ID NO: 1133 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tattccttggctagagtaaaaat

SEQ ID NO: 1134 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tactattccttggctagagtaaa

SEQ ID NO: 1135 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tcacttgtgttcagtttcataaa

SEQ ID NO: 1136 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tgcatcgagtaatgataggtatc

SEQ ID NO: 1137 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tgataaatccagtccgtgaatac

SEQ ID NO: 1138 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
ttcgataaatccagtccgtgaat

SEQ ID NO: 1139 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tttggtatccatggttttcatag

SEQ ID NO: 1140 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tccttacaagtgactaccacgtc

SEQ ID NO: 1141 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
tcacatctttctcttcttcgccg

SEQ ID NO: 1142 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
taacacatctttctcttcttcgc

SEQ ID NO: 1143 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
taaacacatctttctcttcttcg

SEQ ID NO: 1144 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
taaaacacatctttctcttcttc

SEQ ID NO: 1145 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tagagtagtgctcatggttatgg

SEQ ID NO: 1146 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tcattcttgcaaaccagcctgct

SEQ ID NO: 1147 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tctgcaaatgggattgcatgact

SEQ ID NO: 1148 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tagacagatcctgcaaatgggat

SEQ ID NO: 1149 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
taggacttcctctgagatgagta

SEQ ID NO: 1150 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttagttctcgttccagtcgtctt

SEQ ID NO: 1151 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tatccactattccttggctagag

SEQ ID NO: 1152 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgcatcactgtggtacagttttt

SEQ ID NO: 1153 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tgaagaacaggcatcactgtggt

SEQ ID NO: 1154 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tatcagcgcaatgtcattgttct

SEQ ID NO: 1155 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttcatcagcgcaatgtcattgtt

SEQ ID NO: 1156 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tccaaaacaaaacacatctttct

SEQ ID NO: 1157 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tcatggttatggcacttggcaat

SEQ ID NO: 1158 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tcttagtctttgaggtgcacact

SEQ ID NO: 1159 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgcacagtgctttcttagtcttt

SEQ ID NO: 1160 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tcctctgagatgagtacacctga

SEQ ID NO: 1161 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
taagaacaggcatcactgtggta

SEQ ID NO: 1162 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
ttgaagaacaggcatcactgtgg

SEQ ID NO: 1163 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
taccactgcttttgaagaacagg

SEQ ID NO: 1164 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tcagcgcaatgtcattgttcttg

SEQ ID NO: 1165 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tcctgagttcaaagccatcttgc

SEQ ID NO: 1166 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
taccctgagttcaaagccatctt

SEQ ID NO: 1167 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tcacagaatggcagagagtgcca

SEQ ID NO: 1168 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tcaagtgactaccacgtcaccac

SEQ ID NO: 1169 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tacaagtgactaccacgtcacca

SEQ ID NO: 1170 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tcctcaatttccagtgactagca

SEQ ID NO: 1171 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tcatggacctcaatttccagtga

SEQ ID NO: 1172 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tcaaaacacatctttctcttctt

SEQ ID NO: 1173 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
taaacaaaacacatctttctctt

SEQ ID NO: 1174 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
ttccaaaacaaaacacatctttc

SEQ ID NO: 1175 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tccacagagagtccaaaacaaaa

SEQ ID NO: 1176 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tcttcctctgagatgagtacacc

SEQ ID NO: 1177 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tcgcaatgtcattgttcttggtc

SEQ ID NO: 1178 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttcagcgcaatgtcattgttctt

SEQ ID NO: 1179 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tgcttcatcagcgcaatgtcatt

SEQ ID NO: 1180 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tctgaggtcttccctttctcctc

SEQ ID NO: 1181 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
tagaatggcagagagtgccaaag

SEQ ID NO: 1182 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tacacatctttctcttcttcgcc

SEQ ID NO: 1183 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tacaaaacacatctttctcttct

SEQ ID NO: 1184 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
ttcattcttgcaaaccagcctgc

SEQ ID NO: 1185 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tatcctgcaaatgggattgcatg

SEQ ID NO: 1186 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
tgatcctgcaaatgggattgcat

SEQ ID NO: 1187 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tctgctctctacagaggcatgtg

SEQ ID NO: 1188 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tgagtcgcactctatcccagagt

SEQ ID NO: 1189 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tggacttcctctgagatgagtac

SEQ ID NO: 1190 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
tgtagttctcgttccagtcgtct

SEQ ID NO: 1191 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tttccttggctagagtaaaaatt

SEQ ID NO: 1192 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tctattccttggctagagtaaaa

SEQ ID NO: 1193 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
taggcatcactgtggtacagttt

SEQ ID NO: 1194 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tagaacaggcatcactgtggtac

SEQ ID NO: 1195 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tcatcagcgcaatgtcattgttc

SEQ ID NO: 1196 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
tcttcatcagcgcaatgtcattg

SEQ ID NO: 1197 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
tacattcccgtacactcctggtc

SEQ ID NO: 1198 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tataaatccagtccgtgaatacc

SEQ ID NO: 1199 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tccctcatttgtcgataaatcca

SEQ ID NO: 1200 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgtgacctctgaatcatctctaa

SEQ ID NO: 1201 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
taacaaaacacatctttctcttc

SEQ ID NO: 1202 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tgctcatggttatggcacttggc

SEQ ID NO: 1203 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
tgagtagtgctcatggttatggc

SEQ ID NO: 1204 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
tacagacagatcctgcaaatggg

SEQ ID NO: 1205 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tcaggacttcctctgagatgagt

SEQ ID NO: 1206 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
tcacattcccgtacactcctggt

SEQ ID NO: 1207 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tcagagagtgccaaagccagaca

SEQ ID NO: 1208 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tcagaatggcagagagtgccaaa

SEQ ID NO: 1209 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tacagaatggcagagagtgccaa

SEQ ID NO: 1210 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
tttccggttggtatccatggttt

SEQ ID NO: 1211 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ttttccggttggtatccatggtt

SEQ ID NO: 1212 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
tctgagcatccttgatttccccc

SEQ ID NO: 1213 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
tctcatggttatggcacttggca

SEQ ID NO: 1214 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
tcctgcaaatgggattgcatgac

SEQ ID NO: 1215 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
tcagacagatcctgcaaatggga

SEQ ID NO: 1216 - RNA, 23 nt, synthetic construct
  source 1..23: mol_type = other RNA; note = Description of Artificial Sequence: Synthetic oligonucleotide
  modified_base 1: mod_base = OTHER; note = Vinyl-phosphonate 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
tgtgcacagacagatcctgcaaa

SEQ ID NO: 1217 - RNA, 23 nt, Homo sapiens
  source 1..23: mol_type = unassigned RNA
ccttcatttaactctttgaaact

SEQ ID NO: 1218 - RNA, 23 nt, Homo sapiens
  source 1..23: mol_type = unassigned RNA
gaaaacgtcttccttctttattg

SEQ ID NO: 1219 - RNA, 23 nt, Homo sapiens
  source 1..23: mol_type = unassigned RNA
aaaacgtcttccttctttattgc

SEQ ID NO: 1220 - RNA, 23 nt, Homo sapiens
  source 1..23: mol_type = unassigned RNA
aatggtgaaaacgtcttccttct

SEQ ID NO: 1221 - RNA, 23 nt, Homo sapiens
  source 1..23: mol_type = unassigned RNA
agtggtttctttacgctgtatag

SEQ ID NO: 1222 - RNA, 23 nt, Homo sapiens
  source 1..23: mol_type = unassigned RNA
cattccagatacctatcattact

SEQ ID NO: 1223 - RNA, 23 nt, Homo sapiens
  source 1..23: mol_type = unassigned RNA
attccagatacctatcattactc

SEQ ID NO: 1224 - RNA, 23 nt, Homo sapiens
  source 1..23: mol_type = unassigned RNA
tccagatacctatcattactcga

SEQ ID NO: 1225 - RNA, 23 nt, Homo sapiens
  source 1..23: mol_type = unassigned RNA
cagatacctatcattactcgatg

SEQ ID NO: 1226 - RNA, 23 nt, Homo sapiens
  source 1..23: mol_type = unassigned RNA
tgcgtggaaaaacctcttaacaa

SEQ ID NO: 1227 - RNA, 23 nt, Homo sapiens
  source 1..23: mol_type = unassigned RNA
aaagtgatttctcatccaaatta

SEQ ID NO: 1228 - RNA, 23 nt, Homo sapiens
  source 1..23: mol_type = unassigned RNA
tttctcatccaaattatgactcc

SEQ ID NO: 1229 - RNA, 23 nt, Homo sapiens
  source 1..23: mol_type = unassigned RNA
tcatccaaattatgactccaaga

SEQ ID NO: 1230 - RNA, 23 nt, Homo sapiens
  source 1..23: mol_type = unassigned RNA
ggactggatttatcgacaaatga

SEQ ID NO: 1231 - RNA, 23 nt, Homo sapiens
  source 1..23: mol_type = unassigned RNA
cttttgatgtctccaagtagtcc

SEQ ID NO: 1232 - RNA, 23 nt, Homo sapiens
  source 1..23: mol_type = unassigned RNA
cccaagacacatcctaaaaggtg

SEQ ID NO: 1233 - RNA, 23 nt, Homo sapiens
  source 1..23: mol_type = unassigned RNA
ttgtaatggtgaaaacgtcttcc

SEQ ID NO: 1234 - RNA, 23 nt, Homo sapiens
  source 1..23: mol_type = unassigned RNA
ggtgaaaacgtcttccttcttta

SEQ ID NO: 1235 - RNA, 23 nt, Homo sapiens
  source 1..23: mol_type = unassigned RNA
gtgaaaacgtcttccttctttat

SEQ ID NO: 1236 - RNA, 23 nt, Homo sapiens
  source 1..23: mol_type = unassigned RNA
taaactgtaaagttcaattgtga

SEQ ID NO: 1237 - RNA, 23 nt, Homo sapiens
  source 1..23: mol_type = unassigned RNA
gtgtactcatctcagaggaagtc

SEQ ID NO: 1238 - RNA, 23 nt, Homo sapiens
  source 1..23: mol_type = unassigned RNA
gccggcaatgtcgatatctataa

SEQ ID NO: 1239 - RNA, 23 nt, Homo sapiens
  source 1..23: mol_type = unassigned RNA
ccggcaatgtcgatatctataaa

SEQ ID NO: 1240 - RNA, 23 nt, Homo sapiens
  source 1..23: mol_type = unassigned RNA
cggcaatgtcgatatctataaaa

SEQ ID NO: 1241 - RNA, 23 nt, Homo sapiens
  source 1..23: mol_type = unassigned RNA
ggcaatgtcgatatctataaaaa

SEQ ID NO: 1242 - RNA, 23 nt, Homo sapiens
  source 1..23: mol_type = unassigned RNA
cagtggtttctttacgctgtata

SEQ ID NO: 1243 - RNA, 23 nt, Homo sapiens
  source 1..23: mol_type = unassigned RNA
acattccagatacctatcattac

SEQ ID NO: 1244 - RNA, 23 nt, Homo sapiens
  source 1..23: mol_type = unassigned RNA
ttccagatacctatcattactcg

SEQ ID NO: 1245 - RNA, 23 nt, Homo sapiens
  source 1..23: mol_type = unassigned RNA
ccagatacctatcattactcgat

SEQ ID NO: 1246 - RNA, 23 nt, Homo sapiens
  source 1..23: mol_type = unassigned RNA
aagtgatttctcatccaaattat

SEQ ID NO: 1247 - RNA, 23 nt, Homo sapiens
  source 1..23: mol_type = unassigned RNA
agtgatttctcatccaaattatg

SEQ ID NO: 1248 - RNA, 23 nt, Homo sapiens
  source 1..23: mol_type = unassigned RNA
tgatttctcatccaaattatgac

SEQ ID NO: 1249 - RNA, 23 nt, Homo sapiens
  source 1..23: mol_type = unassigned RNA
gatttctcatccaaattatgact

SEQ ID NO: 1250 - RNA, 23 nt, Homo sapiens
  source 1..23: mol_type = unassigned RNA
atttctcatccaaattatgactc

SEQ ID NO: 1251 - RNA, 23 nt, Homo sapiens
  source 1..23: mol_type = unassigned RNA
agaggtcacttcatttttattaa

SEQ ID NO: 1252 - RNA, 23 nt, Homo sapiens
  source 1..23: mol_type = unassigned RNA
ttatgtttctacacattgctacc

SEQ ID NO: 1253 - RNA, 23 nt, Homo sapiens
  source 1..23: mol_type = unassigned RNA
cttcatttaactctttgaaactg

SEQ ID NO: 1254 - RNA, 23 nt, Homo sapiens
  source 1..23: mol_type = unassigned RNA
agctaggacttaaccttgaaatg

SEQ ID NO: 1255 - RNA, 23 nt, Homo sapiens
  source 1..23: mol_type = unassigned RNA
caagacacatcctaaaaggtgtt

SEQ ID NO: 1256 - RNA, 23 nt, Homo sapiens
  source 1..23: mol_type = unassigned RNA
aagacacatcctaaaaggtgttg

SEQ ID NO: 1257 - RNA, 23 nt, Homo sapiens
  source 1..23: mol_type = unassigned RNA
taatggtgaaaacgtcttccttc

SEQ ID NO: 1258 - RNA, 23 nt, Homo sapiens
  source 1..23: mol_type = unassigned RNA
tggtgaaaacgtcttccttcttt

SEQ ID NO: 1259 - RNA, 23 nt, Homo sapiens
  source 1..23: mol_type = unassigned RNA
tgaaaacgtcttccttctttatt

SEQ ID NO: 1260 - RNA, 23 nt, Homo sapiens
  source 1..23: mol_type = unassigned RNA
tgatgcctgttcttcaaaagcag

SEQ ID NO: 1261 - RNA, 23 nt, Homo sapiens
  source 1..23: mol_type = unassigned RNA
atgcctgttcttcaaaagcagtg

SEQ ID NO: 1262 - RNA, 23 nt, Homo sapiens
  source 1..23: mol_type = unassigned RNA
tcttcaaaagcagtggtttcttt

SEQ ID NO: 1263 - RNA, 23 nt, Homo sapiens
  source 1..23: mol_type = unassigned RNA
acctatcattactcgatgctgtt

SEQ ID NO: 1264 - RNA, 23 nt, Homo sapiens
  source 1..23: mol_type = unassigned RNA
actgcgtggaaaaacctcttaac

SEQ ID NO: 1265 - RNA, 23 nt, Homo sapiens
  source 1..23: mol_type = unassigned RNA
accaagtagaaaaagtgatttct

SEQ ID NO: 1266 - RNA, 23 nt, Homo sapiens
  source 1..23: mol_type = unassigned RNA
ccaagtagaaaaagtgatttctc

SEQ ID NO: 1267 - RNA, 23 nt, Homo sapiens
  source 1..23: mol_type = unassigned RNA
aagtagaaaaagtgatttctcat

SEQ ID NO: 1268 - RNA, 23 nt, Homo sapiens
  source 1..23: mol_type = unassigned RNA
agtagaaaaagtgatttctcatc

SEQ ID NO: 1269 - RNA, 23 nt, Homo sapiens
  source 1..23: mol_type = unassigned RNA
gaaaaagtgatttctcatccaaa

SEQ ID NO: 1270 - RNA, 23 nt, Homo sapiens
  source 1..23: mol_type = unassigned RNA
gtgatttctcatccaaattatga

SEQ ID NO: 1271 - RNA, 23 nt, Homo sapiens
  source 1..23: mol_type = unassigned RNA
agaagcctctgactttcaacgac

SEQ ID NO: 1272 - RNA, 23 nt, Homo sapiens
  source 1..23: mol_type = unassigned RNA
ctgctagtcactggaaattgagg

SEQ ID NO: 1273 - RNA, 23 nt, Homo sapiens
  source 1..23: mol_type = unassigned RNA
gcttttgatgtctccaagtagtc

SEQ ID NO: 1274 - RNA, 23 nt, Homo sapiens
  source 1..23: mol_type = unassigned RNA
aagatgtgttttgttttggactc

SEQ ID NO: 1275 - RNA, 23 nt, Homo sapiens
  source 1..23: mol_type = unassigned RNA
tgttttgttttggactctctgtg

SEQ ID NO: 1276 - RNA, 23 nt, Homo sapiens
  source 1..23: mol_type = unassigned RNA
aggctggtttgcaagaatgaaat

SEQ ID NO: 1277 - RNA, 23 nt, Homo sapiens
  source 1..23: mol_type = unassigned RNA
gctggtttgcaagaatgaaatga

SEQ ID NO: 1278 - RNA, 23 nt, Homo sapiens
  source 1..23: mol_type = unassigned RNA
ctggtttgcaagaatgaaatgaa

SEQ ID NO: 1279 - RNA, 23 nt, Homo sapiens
  source 1..23: mol_type = unassigned RNA
gctaggacttaaccttgaaatgg

SEQ ID NO: 1280 - RNA, 23 nt, Homo sapiens
  source 1..23: mol_type = unassigned RNA
atggtgaaaacgtcttccttctt

SEQ ID NO: 1281 - RNA, 23 nt, Homo sapiens
  source 1..23: mol_type = unassigned RNA
aaacgtcttccttctttattgcc

SEQ ID NO: 1282 - RNA, 23 nt, Homo sapiens
  source 1..23: mol_type = unassigned RNA
aacgtcttccttctttattgccc

SEQ ID NO: 1283 - RNA, 23 nt, Homo sapiens
  source 1..23: mol_type = unassigned RNA
aactgtaaagttcaattgtgaaa

SEQ ID NO: 1284 - RNA, 23 nt, Homo sapiens
  source 1..23: mol_type = unassigned RNA
gtgcacctcaaagactaagaaag

SEQ ID NO: 1285 - RNA, 23 nt, Homo sapiens
  source 1..23: mol_type = unassigned RNA
tgcacctcaaagactaagaaagc

SEQ ID NO: 1286 - RNA, 23 nt, Homo sapiens
  source 1..23: mol_type = unassigned RNA
ggatccaccagctttatgaaact

SEQ ID NO: 1287 - RNA, 23 nt, Homo sapiens
  source 1..23: mol_type = unassigned RNA
agtgatgcctgttcttcaaaagc

SEQ ID NO: 1288 - RNA, 23 nt, Homo sapiens
  source 1..23: mol_type = unassigned RNA
gtgatgcctgttcttcaaaagca

SEQ ID NO: 1289 - RNA, 23 nt, Homo sapiens
  source 1..23: mol_type = unassigned RNA
gatgcctgttcttcaaaagcagt

SEQ ID NO: 1290 - RNA, 23 nt, Homo sapiens
  source 1..23: mol_type = unassigned RNA
gttcttcaaaagcagtggtttct

SEQ ID NO: 1291 - RNA, 23 nt, Homo sapiens
  source 1..23: mol_type = unassigned RNA
aacattccagatacctatcatta

SEQ ID NO: 1292 - RNA, 23 nt, Homo sapiens
  source 1..23: mol_type = unassigned RNA
atacctatcattactcgatgctg

SEQ ID NO: 1293 - RNA, 23 nt, Homo sapiens
  source 1..23: mol_type = unassigned RNA
ctgcgtggaaaaacctcttaaca

SEQ ID NO: 1294 - RNA, 23 nt, Homo sapiens
  source 1..23: mol_type = unassigned RNA
atcattactcgatgctgttgata

SEQ ID NO: 1295 - RNA, 23 nt, Homo sapiens
  source 1..23: mol_type = unassigned RNA
cattactcgatgctgttgataac

SEQ ID NO: 1296 - RNA, 23 nt, Homo sapiens
  source 1..23: mol_type = unassigned RNA
ccaagaacaatgacattgcgctg

SEQ ID NO: 1297 - RNA, 23 nt, Homo sapiens
  source 1..23: mol_type = unassigned RNA
taacagcaagatggctttgaact

SEQ ID NO: 1298 - RNA, 23 nt, Homo sapiens
  source 1..23: mol_type = unassigned RNA
aacagcaagatggctttgaactc

SEQ ID NO: 1299 - RNA, 23 nt, Homo sapiens
  source 1..23: mol_type = unassigned RNA
attcagaggtcacttcattttta

SEQ ID NO: 1300 - RNA, 23 nt, Homo sapiens
  source 1..23: mol_type = unassigned RNA
ttcagaggtcacttcatttttat

SEQ ID NO: 1301 - RNA, 23 nt, Homo sapiens
  source 1..23: mol_type = unassigned RNA
catgttatgtttctacacattgc

SEQ ID NO: 1302 - RNA, 23 nt, Homo sapiens
  source 1..23: mol_type = unassigned RNA
gttatgtttctacacattgctac

SEQ ID NO: 1303 - RNA, 23 nt, Homo sapiens
  source 1..23: mol_type = unassigned RNA
taacgttctataaatgaatgtgc

SEQ ID NO: 1304 - RNA, 23 nt, Homo sapiens
  source 1..23: mol_type = unassigned RNA
gtgttttgttttggactctctgt

SEQ ID NO: 1305 - RNA, 23 nt, Homo sapiens
  source 1..23: mol_type = unassigned RNA
tggtttgcaagaatgaaatgaat

SEQ ID NO: 1306 - RNA, 23 nt, Homo sapiens
  source 1..23: mol_type = unassigned RNA
gcaagaatgaaatgaatgattct

SEQ ID NO: 1307 - RNA, 23 nt, Homo sapiens
  source 1..23: mol_type = unassigned RNA
cagctaggacttaaccttgaaat

SEQ ID NO: 1308 - RNA, 23 nt, Homo sapiens
  source 1..23: mol_type = unassigned RNA
ccaagacacatcctaaaaggtgt

SEQ ID NO: 1309 - RNA, 23 nt, Homo sapiens
  source 1..23: mol_type = unassigned RNA
gttgtaatggtgaaaacgtcttc

SEQ ID NO: 1310 - RNA, 23 nt, Homo sapiens
  source 1..23: mol_type = unassigned RNA
gtaatggtgaaaacgtcttcctt

SEQ ID NO: 1311 - RNA, 23 nt, Homo sapiens
  source 1..23: mol_type = unassigned RNA
aaactgtaaagttcaattgtgaa

SEQ ID NO: 1312 - RNA, 23 nt, Homo sapiens
  source 1..23: mol_type = unassigned RNA
actgtaaagttcaattgtgaaaa

SEQ ID NO: 1313 - RNA, 23 nt, Homo sapiens
  source 1..23: mol_type = unassigned RNA
gcacctcaaagactaagaaagca

SEQ ID NO: 1314 - RNA, 23 nt, Homo sapiens
  source 1..23: mol_type = unassigned RNA
cacctcaaagactaagaaagcac

SEQ ID NO: 1315 - RNA, 23 nt, Homo sapiens
  source 1..23: mol_type = unassigned RNA
acctcaaagactaagaaagcact

SEQ ID NO: 1316 - RNA, 23 nt, Homo sapiens
  source 1..23: mol_type = unassigned RNA
tccaccagctttatgaaactgaa

SEQ ID NO: 1317 - RNA, 23 nt, Homo sapiens
  source 1..23: mol_type = unassigned RNA
tgccggcaatgtcgatatctata

SEQ ID NO: 1318 - RNA, 23 nt, Homo sapiens
  source 1..23: mol_type = unassigned RNA
ctgttcttcaaaagcagtggttt

SEQ ID NO: 1319 - RNA, 23 nt, Homo sapiens
  source 1..23: mol_type = unassigned RNA
ttcttcaaaagcagtggtttctt

SEQ ID NO: 1320 - RNA, 23 nt, Homo sapiens
  source 1..23: mol_type = unassigned RNA
tattgaacattccagatacctat

SEQ ID NO: 1321 - RNA, 23 nt, Homo sapiens
  source 1..23: mol_type = unassigned RNA
gaacattccagatacctatcatt

SEQ ID NO: 1322 - RNA, 23 nt, Homo sapiens
  source 1..23: mol_type = unassigned RNA
tatcattactcgatgctgttgat

SEQ ID NO: 1323 - RNA, 23 nt, Homo sapiens
  source 1..23: mol_type = unassigned RNA
caagtagaaaaagtgatttctca

SEQ ID NO: 1324 - RNA, 23 nt, Homo sapiens
  source 1..23: mol_type = unassigned RNA
gactccaagaccaagaacaatga

SEQ ID NO: 1325 - RNA, 23 nt, Homo sapiens
  source 1..23: mol_type = unassigned RNA
tccaagaccaagaacaatgacat

SEQ ID NO: 1326 - RNA, 23 nt, Homo sapiens
  source 1..23: mol_type = unassigned RNA
agcaagatggctttgaactcagg

SEQ ID NO: 1327 - RNA, 23 nt, Homo sapiens
  source 1..23: mol_type = unassigned RNA
gtgacgtggtagtcacttgtaag

SEQ ID NO: 1328 - RNA, 23 nt, Homo sapiens
  source 1..23: mol_type = unassigned RNA
atgttatgtttctacacattgct

SEQ ID NO: 1329 - RNA, 23 nt, Homo sapiens
  source 1..23: mol_type = unassigned RNA
ggtttgcaagaatgaaatgaatg

SEQ ID NO: 1330 - RNA, 23 nt, Homo sapiens
  source 1..23: mol_type = unassigned RNA
ctaggacttaaccttgaaatgga

SEQ ID NO: 1331 - RNA, 23 nt, Homo sapiens
  source 1..23: mol_type = unassigned RNA
attgtgaaaatgaatatcatgca

SEQ ID NO: 1332 - RNA, 23 nt, Homo sapiens
  source 1..23: mol_type = unassigned RNA
acagtgatgcctgttcttcaaaa

SEQ ID NO: 1333 - RNA, 23 nt, Homo sapiens
  source 1..23: mol_type = unassigned RNA
tgttcttcaaaagcagtggtttc

SEQ ID NO: 1334 - RNA, 23 nt, Homo sapiens
  source 1..23: mol_type = unassigned RNA
cttcaaaagcagtggtttcttta

SEQ ID NO: 1335 - RNA, 23 nt, Homo sapiens
  source 1..23: mol_type = unassigned RNA
ttcaaaagcagtggtttctttac

SEQ ID NO: 1336 - RNA, 23 nt, Homo sapiens
  source 1..23: mol_type = unassigned RNA
gtggtttctttacgctgtatagc

SEQ ID NO: 1337 - RNA, 23 nt, Homo sapiens
  source 1..23: mol_type = unassigned RNA
agatacctatcattactcgatgc

SEQ ID NO: 1338 - RNA, 23 nt, Homo sapiens
  source 1..23: mol_type = unassigned RNA
ctatcattactcgatgctgttga

SEQ ID NO: 1339 - RNA, 23 nt, Homo sapiens
  source 1..23: mol_type = unassigned RNA
agaaaaagtgatttctcatccaa

SEQ ID NO: 1340 - RNA, 23 nt, Homo sapiens
  source 1..23: mol_type = unassigned RNA
tgactccaagaccaagaacaatg

SEQ ID NO: 1341 - RNA, 23 nt, Homo sapiens
  source 1..23: mol_type = unassigned RNA
ctccaagaccaagaacaatgaca

SEQ ID NO: 1342 - RNA, 23 nt, Homo sapiens
  source 1..23: mol_type = unassigned RNA
ccaagaccaagaacaatgacatt

SEQ ID NO: 1343 - RNA, 23 nt, Homo sapiens
  source 1..23: mol_type = unassigned RNA
gactggatttatcgacaaatgag

SEQ ID NO: 1344 - RNA, 23 nt, Homo sapiens
  source 1..23: mol_type = unassigned RNA
gattcagaggtcacttcattttt

SEQ ID NO: 1345 - RNA, 23 nt, Homo sapiens
  source 1..23: mol_type = unassigned RNA
tcagaggtcacttcatttttatt

SEQ ID NO: 1346 - RNA, 23 nt, Homo sapiens
  source 1..23: mol_type = unassigned RNA
cagaggtcacttcatttttatta

SEQ ID NO: 1347 - RNA, 23 nt, Homo sapiens
  source 1..23: mol_type = unassigned RNA
ggggaacagaaacatttttgttc

SEQ ID NO: 1348 - RNA, 23 nt, Homo sapiens
  source 1..23: mol_type = unassigned RNA
cctgctagtcactggaaattgag

SEQ ID NO: 1349 - RNA, 23 nt, Homo sapiens
  source 1..23: mol_type = unassigned RNA
tgttatgtttctacacattgcta

SEQ ID NO: 1350 - RNA, 23 nt, Homo sapiens
  source 1..23: mol_type = unassigned RNA
agcttttgatgtctccaagtagt

SEQ ID NO: 1351 - RNA, 23 nt, Homo sapiens
  source 1..23: mol_type = unassigned RNA
tttgatgtctccaagtagtccac

SEQ ID NO: 1352 - RNA, 23 nt, Homo sapiens
  source 1..23: mol_type = unassigned RNA
cgttctataaatgaatgtgctga

SEQ ID NO: 1353 - RNA, 23 nt, Homo sapiens
  source 1..23: mol_type = unassigned RNA
caagaatgaaatgaatgattcta

SEQ ID NO: 1354 - RNA, 23 nt, Homo sapiens
  source 1..23: mol_type = unassigned RNA
agaatgaaatgaatgattctaca

SEQ ID NO: 1355 - RNA, 23 nt, Homo sapiens
  source 1..23: mol_type = unassigned RNA
taggacttaaccttgaaatggaa

SEQ ID NO: 1356 - RNA, 23 nt, Homo sapiens
  source 1..23: mol_type = unassigned RNA
aggacttaaccttgaaatggaaa

SEQ ID NO: 1357 - RNA, 23 nt, Homo sapiens
  source 1..23: mol_type = unassigned RNA
aaagtcatgcaatcccatttgca

SEQ ID NO: 1358 - RNA, 23 nt, Homo sapiens
  source 1..23: mol_type = unassigned RNA
aagtcatgcaatcccatttgcag

SEQ ID NO: 1359 - RNA, 23 nt, Homo sapiens
  source 1..23: mol_type = unassigned RNA
gtgtgcacctcaaagactaagaa

SEQ ID NO: 1360 - RNA, 23 nt, Homo sapiens
  source 1..23: mol_type = unassigned RNA
gatccaccagctttatgaaactg

SEQ ID NO: 1361 - RNA, 23 nt, Homo sapiens
  source 1..23: mol_type = unassigned RNA
ccagctttatgaaactgaacaca

SEQ ID NO: 1362 - RNA, 23 nt, Homo sapiens
  source 1..23: mol_type = unassigned RNA
ttatgaaactgaacacaagtgcc

SEQ ID NO: 1363 - RNA, 23 nt, Homo sapiens
  source 1..23: mol_type = unassigned RNA
atattgaacattccagataccta

SEQ ID NO: 1364 - RNA, 23 nt, Homo sapiens
  source 1..23: mol_type = unassigned RNA
tcaaaagcagtggtttctttacg

SEQ ID NO: 1365 - RNA, 23 nt, Homo sapiens
  source 1..23: mol_type = unassigned RNA
tggtttctttacgctgtatagcc

SEQ ID NO: 1366 - RNA, 23 nt, Homo sapiens
  source 1..23: mol_type = unassigned RNA
tcattactcgatgctgttgataa

SEQ ID NO: 1367 - RNA, 23 nt, Homo sapiens
  source 1..23: mol_type = unassigned RNA
aagaccaagaacaatgacattgc

SEQ ID NO: 1368 - RNA, 23 nt, Homo sapiens
  source 1..23: mol_type = unassigned RNA
agaccaagaacaatgacattgcg

SEQ ID NO: 1369 - RNA, 23 nt, Homo sapiens
  source 1..23: mol_type = unassigned RNA
acagcaagatggctttgaactca

SEQ ID NO: 1370 - RNA, 23 nt, Homo sapiens
  source 1..23: mol_type = unassigned RNA
ttcacggactggatttatcgaca

SEQ ID NO: 1371 - RNA, 23 nt, Homo sapiens
  source 1..23: mol_type = unassigned RNA
tcacggactggatttatcgacaa

SEQ ID NO: 1372 - RNA, 23 nt, Homo sapiens
  source 1..23: mol_type = unassigned RNA
actggatttatcgacaaatgagg

SEQ ID NO: 1373 - RNA, 23 nt, Homo sapiens
  source 1..23: mol_type = unassigned RNA
tgacgtggtagtcacttgtaagg

SEQ ID NO: 1374 - RNA, 23 nt, Homo sapiens
  source 1..23: mol_type = unassigned RNA
gctagtcactggaaattgaggtc

SEQ ID NO: 1375 - RNA, 23 nt, Homo sapiens
  source 1..23: mol_type = unassigned RNA
ggaaatcaaggatgctcagttta

SEQ ID NO: 1376 - RNA, 23 nt, Homo sapiens
  source 1..23: mol_type = unassigned RNA
gttctataaatgaatgtgctgaa

SEQ ID NO: 1377 - RNA, 23 nt, Homo sapiens
  source 1..23: mol_type = unassigned RNA
tctataaatgaatgtgctgaagc

SEQ ID NO: 1378 - RNA, 23 nt, Homo sapiens
  source 1..23: mol_type = unassigned RNA
gttttgttttggactctctgtgg

SEQ ID NO: 1379 - RNA, 23 nt, Homo sapiens
  source 1..23: mol_type = unassigned RNA
caggctggtttgcaagaatgaaa

SEQ ID NO: 1380 - RNA, 23 nt, Homo sapiens
  source 1..23: mol_type = unassigned RNA
acagctaggacttaaccttgaaa

SEQ ID NO: 1381 - RNA, 23 nt, Homo sapiens
  source 1..23: mol_type = unassigned RNA
aatcccatttgcaggatctgtct

SEQ ID NO: 1382 - RNA, 23 nt, Homo sapiens
  source 1..23: mol_type = unassigned RNA
gtaaagttcaattgtgaaaatga

SEQ ID NO: 1383 - RNA, 23 nt, Homo sapiens
  source 1..23: mol_type = unassigned RNA
tgtgcacctcaaagactaagaaa

SEQ ID NO: 1384 - RNA, 23 nt, Homo sapiens
  source 1..23: mol_type = unassigned RNA
tcaaagactaagaaagcactgtg

SEQ ID NO: 1385 - RNA, 23 nt, Homo sapiens
  source 1..23: mol_type = unassigned RNA
ttcaggtgtactcatctcagagg

SEQ ID NO: 1386 - RNA, 23 nt, Homo sapiens
  source 1..23: mol_type = unassigned RNA
ttactctagccaaggaatagtgg

SEQ ID NO: 1387 - RNA, 23 nt, Homo sapiens
  source 1..23: mol_type = unassigned RNA
cacagtgatgcctgttcttcaaa

SEQ ID NO: 1388 - RNA, 23 nt, Homo sapiens
  source 1..23: mol_type = unassigned RNA
caaaagcagtggtttctttacgc

SEQ ID NO: 1389 - RNA, 23 nt, Homo sapiens
  source 1..23: mol_type = unassigned RNA
aagcagtggtttctttacgctgt

SEQ ID NO: 1390 - RNA, 23 nt, Homo sapiens
  source 1..23: mol_type = unassigned RNA
agcagtggtttctttacgctgta

SEQ ID NO: 1391 - RNA, 23 nt, Homo sapiens
  source 1..23: mol_type = unassigned RNA
tacctatcattactcgatgctgt

SEQ ID NO: 1392 - RNA, 23 nt, Homo sapiens
  source 1..23: mol_type = unassigned RNA
ttatgactccaagaccaagaaca

SEQ ID NO: 1393 - RNA, 23 nt, Homo sapiens
  source 1..23: mol_type = unassigned RNA
actccaagaccaagaacaatgac

SEQ ID NO: 1394 - RNA, 23 nt, Homo sapiens
  source 1..23: mol_type = unassigned RNA
tattcacggactggatttatcga

SEQ ID NO: 1395 - RNA, 23 nt, Homo sapiens
  source 1..23: mol_type = unassigned RNA
gatgattcagaggtcacttcatt

SEQ ID NO: 1396 - RNA, 23 nt, Homo sapiens
  source 1..23: mol_type = unassigned RNA
atgattcagaggtcacttcattt

SEQ ID NO: 1397 - RNA, 23 nt, Homo sapiens
  source 1..23: mol_type = unassigned RNA
tgattcagaggtcacttcatttt

SEQ ID NO: 1398 - RNA, 23 nt, Homo sapiens
  source 1..23: mol_type = unassigned RNA
ctagtcactggaaattgaggtcc

SEQ ID NO: 1399 - RNA, 23 nt, Homo sapiens
  source 1..23: mol_type = unassigned RNA
atgtttctacacattgctacctc

SEQ ID NO: 1400 - RNA, 23 nt, Homo sapiens
  source 1..23: mol_type = unassigned RNA
tgtttctacacattgctacctca

SEQ ID NO: 1401 - RNA, 23 nt, Homo sapiens
  source 1..23: mol_type = unassigned RNA
ttttgatgtctccaagtagtcca

SEQ ID NO: 1402 - RNA, 23 nt, Homo sapiens
  source 1..23: mol_type = unassigned RNA
acgttctataaatgaatgtgctg

SEQ ID NO: 1403 - RNA, 23 nt, Homo sapiens
  source 1..23: mol_type = unassigned RNA
tttgttttggactctctgtggtc

SEQ ID NO: 1404 - RNA, 23 nt, Homo sapiens
  source 1..23: mol_type = unassigned RNA
cataaccatgagcactactctac

SEQ ID NO: 1405 - RNA, 23 nt, Homo sapiens
  source 1..23: mol_type = unassigned RNA
aagcaggctggtttgcaagaatg

SEQ ID NO: 1406 - RNA, 23 nt, Homo sapiens
  source 1..23: mol_type = unassigned RNA
tgcaagaatgaaatgaatgattc

SEQ ID NO: 1407 - RNA, 23 nt, Homo sapiens
  source 1..23: mol_type = unassigned RNA
caaagactaagaaagcactgtgc

SEQ ID NO: 1408 - RNA, 23 nt, Homo sapiens
  source 1..23: mol_type = unassigned RNA
tccttcaggtgtactcatctcag

SEQ ID NO: 1409 - RNA, 23 nt, Homo sapiens
  source 1..23: mol_type = unassigned RNA
ccttcaggtgtactcatctcaga

SEQ ID NO: 1410 - RNA, 23 nt, Homo sapiens
  source 1..23: mol_type = unassigned RNA
atccaccagctttatgaaactga

SEQ ID NO: 1411 - RNA, 23 nt, Homo sapiens
  source 1..23: mol_type = unassigned RNA
aaaagcagtggtttctttacgct

SEQ ID NO: 1412 - RNA, 23 nt, Homo sapiens
  source 1..23: mol_type = unassigned RNA
aaagcagtggtttctttacgctg

SEQ ID NO: 1413 - RNA, 23 nt, Homo sapiens
  source 1..23: mol_type = unassigned RNA
accaagaacaatgacattgcgct

SEQ ID NO: 1414 - RNA, 23 nt, Homo sapiens
  source 1..23: mol_type = unassigned RNA
cacggactggatttatcgacaaa

SEQ ID NO: 1415 - RNA, 23 nt, Homo sapiens
  source 1..23: mol_type = unassigned RNA
ctggatttatcgacaaatgaggg

SEQ ID NO: 1416 - RNA, 23 nt, Homo sapiens
  source 1..23: mol_type = unassigned RNA
ggtgacgtggtagtcacttgtaa

SEQ ID NO: 1417 - RNA, 23 nt, Homo sapiens
  source 1..23: mol_type = unassigned RNA
aacgttctataaatgaatgtgct

SEQ ID NO: 1418 - RNA, 23 nt, Homo sapiens
  source 1..23: mol_type = unassigned RNA
agagaaagatgtgttttgttttg

SEQ ID NO: 1419 - RNA, 23 nt, Homo sapiens
  source 1..23: mol_type = unassigned RNA
gagaaagatgtgttttgttttgg

SEQ ID NO: 1420 - RNA, 23 nt, Homo sapiens
  source 1..23: mol_type = unassigned RNA
aaagatgtgttttgttttggact

SEQ ID NO: 1421 - RNA, 23 nt, Homo sapiens
  source 1..23: mol_type = unassigned RNA
gtttgcaagaatgaaatgaatga

SEQ ID NO: 1422 - RNA, 23 nt, Homo sapiens
  source 1..23: mol_type = unassigned RNA
tttgcaagaatgaaatgaatgat

SEQ ID NO: 1423 - RNA, 23 nt, Homo sapiens
  source 1..23: mol_type = unassigned RNA
ttgcaagaatgaaatgaatgatt

SEQ ID NO: 1424 - RNA, 23 nt, Homo sapiens
  source 1..23: mol_type = unassigned RNA
gaaagtcatgcaatcccatttgc

SEQ ID NO: 1425 - RNA, 23 nt, Homo sapiens
  source 1..23: mol_type = unassigned RNA
caatcccatttgcaggatctgtc

SEQ ID NO: 1426 - RNA, 23 nt, Homo sapiens
  source 1..23: mol_type = unassigned RNA
cctctgtagagagcagcattccc

SEQ ID NO: 1427 - RNA, 23 nt, Homo sapiens
  source 1..23: mol_type = unassigned RNA
tgtaatggtgaaaacgtcttcct

SEQ ID NO: 1428 - RNA, 23 nt, Homo sapiens
  source 1..23: mol_type = unassigned RNA
ttgtgaaaatgaatatcatgcaa

SEQ ID NO: 1429 - RNA, 23 nt, Homo sapiens
  source 1..23: mol_type = unassigned RNA
tgtgaaaatgaatatcatgcaaa

SEQ ID NO: 1430 - RNA, 23 nt, Homo sapiens
  source 1..23: mol_type = unassigned RNA
atccttcaggtgtactcatctca

SEQ ID NO: 1431 - RNA, 23 nt, Homo sapiens
  source 1..23: mol_type = unassigned RNA
gacgactggaacgagaactacgg

SEQ ID NO: 1432 - RNA, 23 nt, Homo sapiens
  source 1..23: mol_type = unassigned RNA
cagggacatgggctataagaata

SEQ ID NO: 1433 - RNA, 23 nt, Homo sapiens
  source 1..23: mol_type = unassigned RNA
atttttactctagccaaggaata

SEQ ID NO: 1434 - RNA, 23 nt, Homo sapiens
  source 1..23: mol_type = unassigned RNA
tttactctagccaaggaatagtg

SEQ ID NO: 1435 - RNA, 23 nt, Homo sapiens
  source 1..23: mol_type = unassigned RNA
tttatgaaactgaacacaagtgc

SEQ ID NO: 1436 - RNA, 23 nt, Homo sapiens
  source 1..23: mol_type = unassigned RNA
gatacctatcattactcgatgct

SEQ ID NO: 1437 - RNA, 23 nt, Homo sapiens
  source 1..23: mol_type = unassigned RNA
gtattcacggactggatttatcg

SEQ ID NO: 1438 - RNA, 23 nt, Homo sapiens
  source 1..23: mol_type = unassigned RNA
attcacggactggatttatcgac

SEQ ID NO: 1439 - RNA, 23 nt, Homo sapiens
  source 1..23: mol_type = unassigned RNA
ctatgaaaaccatggataccaac

SEQ ID NO: 1440 - RNA, 23 nt, Homo sapiens
  source 1..23: mol_type = unassigned RNA
gacgtggtagtcacttgtaaggg

SEQ ID NO: 1441 - RNA, 23 nt, Homo sapiens
  source 1..23: mol_type = unassigned RNA
cggcgaagaagagaaagatgtgt

SEQ ID NO: 1442 - RNA, 23 nt, Homo sapiens
  source 1..23: mol_type = unassigned RNA
gcgaagaagagaaagatgtgttt

SEQ ID NO: 1443 - RNA, 23 nt, Homo sapiens
  source 1..23: mol_type = unassigned RNA
cgaagaagagaaagatgtgtttt

SEQ ID NO: 1444 - RNA, 23 nt, Homo sapiens
  source 1..23: mol_type = unassigned RNA
gaagaagagaaagatgtgttttg

SEQ ID NO: 1445 - RNA, 23 nt, Homo sapiens
  source 1..23: mol_type = unassigned RNA
ccataaccatgagcactactcta

SEQ ID NO: 1446 - RNA, 23 nt, Homo sapiens
  source 1..23: mol_type = unassigned RNA
agcaggctggtttgcaagaatga

SEQ ID NO: 1447 - RNA, 23 nt, Homo sapiens
  source 1..23: mol_type = unassigned RNA
agtcatgcaatcccatttgcagg

SEQ ID NO: 1448 - RNA, 23 nt, Homo sapiens
  source 1..23: mol_type = unassigned RNA
atcccatttgcaggatctgtctg

SEQ ID NO: 1449 - RNA, 23 nt, Homo sapiens
  source 1..23: mol_type = unassigned RNA
tactcatctcagaggaagtcctg

SEQ ID NO: 1450 - RNA, 23 nt, Homo sapiens
  source 1..23: mol_type = unassigned RNA
aagacgactggaacgagaactac

SEQ ID NO: 1451 - RNA, 23 nt, Homo sapiens
  source 1..23: mol_type = unassigned RNA
ctctagccaaggaatagtggatg

SEQ ID NO: 1452 - RNA, 23 nt, Homo sapiens
  source 1..23: mol_type = unassigned RNA
aaaaactgtaccacagtgatgcc

SEQ ID NO: 1453 - RNA, 23 nt, Homo sapiens
  source 1..23: mol_type = unassigned RNA
accacagtgatgcctgttcttca

SEQ ID NO: 1454 - RNA, 23 nt, Homo sapiens
  source 1..23: mol_type = unassigned RNA
agaacaatgacattgcgctgatg

SEQ ID NO: 1455 - RNA, 23 nt, Homo sapiens
  source 1..23: mol_type = unassigned RNA
aacaatgacattgcgctgatgaa

SEQ ID NO: 1456 - RNA, 23 nt, Homo sapiens
  source 1..23: mol_type = unassigned RNA
agaaagatgtgttttgttttgga

SEQ ID NO: 1457 - RNA, 23 nt, Homo sapiens
  source 1..23: mol_type = unassigned RNA
attgccaagtgccataaccatga

SEQ ID NO: 1458 - RNA, 23 nt, Homo sapiens
  source 1..23: mol_type = unassigned RNA
agtgtgcacctcaaagactaaga

SEQ ID NO: 1459 - RNA, 23 nt, Homo sapiens
  source 1..23: mol_type = unassigned RNA
aaagactaagaaagcactgtgca

SEQ ID NO: 1460 - RNA, 23 nt, Homo sapiens
  source 1..23: mol_type = unassigned RNA
tcaggtgtactcatctcagagga

SEQ ID NO: 1461 - RNA, 23 nt, Homo sapiens
  source 1..23: mol_type = unassigned RNA
taccacagtgatgcctgttcttc

SEQ ID NO: 1462 - RNA, 23 nt, Homo sapiens
  source 1..23: mol_type = unassigned RNA
ccacagtgatgcctgttcttcaa

SEQ ID NO: 1463 - RNA, 23 nt, Homo sapiens
  source 1..23: mol_type = unassigned RNA
cctgttcttcaaaagcagtggtt

SEQ ID NO: 1464 - RNA, 23 nt, Homo sapiens
  source 1..23: mol_type = unassigned RNA
caagaacaatgacattgcgctga

SEQ ID NO: 1465 - RNA, 23 nt, Homo sapiens
  source 1..23: mol_type = unassigned RNA
gcaagatggctttgaactcaggg

SEQ ID NO: 1466 - RNA, 23 nt, Homo sapiens
  source 1..23: mol_type = unassigned RNA
aagatggctttgaactcagggtc

SEQ ID NO: 1467 - RNA, 23 nt, Homo sapiens
  source 1..23: mol_type = unassigned RNA
tggcactctctgccattctgtgc

SEQ ID NO: 1468 - RNA, 23 nt, Homo sapiens
  source 1..23: mol_type = unassigned RNA
gtggtgacgtggtagtcacttgt

SEQ ID NO: 1469 - RNA, 23 nt, Homo sapiens
  source 1..23: mol_type = unassigned RNA
tggtgacgtggtagtcacttgta

SEQ ID NO: 1470 - RNA, 23 nt, Homo sapiens
  source 1..23: mol_type = unassigned RNA
tgctagtcactggaaattgaggt

SEQ ID NO: 1471 - RNA, 23 nt, Homo sapiens
  source 1..23: mol_type = unassigned RNA
tcactggaaattgaggtccatgg

SEQ ID NO: 1472 - RNA, 23 nt, Homo sapiens
  source 1..23: mol_type = unassigned RNA
aagaagagaaagatgtgttttgt

SEQ ID NO: 1473 - RNA, 23 nt, Homo sapiens
  source 1..23: mol_type = unassigned RNA
aagagaaagatgtgttttgtttt

SEQ ID NO: 1474 - RNA, 23 nt, Homo sapiens
  source 1..23: mol_type = unassigned RNA
gaaagatgtgttttgttttggac

SEQ ID NO: 1475 - RNA, 23 nt, Homo sapiens
  source 1..23: mol_type = unassigned RNA
ttttgttttggactctctgtggt

SEQ ID NO: 1476 - RNA, 23 nt, Homo sapiens
  source 1..23: mol_type = unassigned RNA
ggtgtactcatctcagaggaagt

SEQ ID NO: 1477 - RNA, 23 nt, Homo sapiens
  source 1..23: mol_type = unassigned RNA
gaccaagaacaatgacattgcgc

SEQ ID NO: 1478 - RNA, 23 nt, Homo sapiens
  source 1..23: mol_type = unassigned RNA
aagaacaatgacattgcgctgat

SEQ ID NO: 1479 - RNA, 23 nt, Homo sapiens
  source 1..23: mol_type = unassigned RNA
aatgacattgcgctgatgaagct

SEQ ID NO: 1480 - RNA, 23 nt, Homo sapiens
  source 1..23: mol_type = unassigned RNA
gaggagaaagggaagacctcaga

SEQ ID NO: 1481 - RNA, 23 nt, Homo sapiens
  source 1..23: mol_type = unassigned RNA
ctttggcactctctgccattctg

SEQ ID NO: 1482 - RNA, 23 nt, Homo sapiens
  source 1..23: mol_type = unassigned RNA
ggcgaagaagagaaagatgtgtt

SEQ ID NO: 1483 - RNA, 23 nt, Homo sapiens
  source 1..23: mol_type = unassigned RNA
agaagagaaagatgtgttttgtt

SEQ ID NO: 1484 - RNA, 23 nt, Homo sapiens
  source 1..23: mol_type = unassigned RNA
gcaggctggtttgcaagaatgaa

SEQ ID NO: 1485 - RNA, 23 nt, Homo sapiens
  source 1..23: mol_type = unassigned RNA
catgcaatcccatttgcaggatc

SEQ ID NO: 1486 - RNA, 23 nt, Homo sapiens
  source 1..23: mol_type = unassigned RNA
atgcaatcccatttgcaggatct

SEQ ID NO: 1487 - RNA, 23 nt, Homo sapiens
  source 1..23: mol_type = unassigned RNA
cacatgcctctgtagagagcagc

SEQ ID NO: 1488 - RNA, 23 nt, Homo sapiens
  source 1..23: mol_type = unassigned RNA
actctgggatagagtgcgactcc

SEQ ID NO: 1489 - RNA, 23 nt, Homo sapiens
  source 1..23: mol_type = unassigned RNA
gtactcatctcagaggaagtcct

SEQ ID NO: 1490 - RNA, 23 nt, Homo sapiens
  source 1..23: mol_type = unassigned RNA
agacgactggaacgagaactacg

SEQ ID NO: 1491 - RNA, 23 nt, Homo sapiens
  source 1..23: mol_type = unassigned RNA
aatttttactctagccaaggaat

SEQ ID NO: 1492 - RNA, 23 nt, Homo sapiens
  source 1..23: mol_type = unassigned RNA
ttttactctagccaaggaatagt

SEQ ID NO: 1493 - RNA, 23 nt, Homo sapiens
  source 1..23: mol_type = unassigned RNA
aaactgtaccacagtgatgcctg

SEQ ID NO: 1494 - RNA, 23 nt, Homo sapiens
  source 1..23: mol_type = unassigned RNA
gtaccacagtgatgcctgttctt

SEQ ID NO: 1495 - RNA, 23 nt, Homo sapiens
  source 1..23: mol_type = unassigned RNA
gaacaatgacattgcgctgatga

SEQ ID NO: 1496 - RNA, 23 nt, Homo sapiens
  source 1..23: mol_type = unassigned RNA
caatgacattgcgctgatgaagc

SEQ ID NO: 1497 - RNA, 23 nt, Homo sapiens
  source 1..23: mol_type = unassigned RNA
gaccaggagtgtacgggaatgtg

SEQ ID NO: 1498 - RNA, 23 nt, Homo sapiens
  source 1..23: mol_type = unassigned RNA
ggtattcacggactggatttatc

SEQ ID NO: 1499 - RNA, 23 nt, Homo sapiens
  source 1..23: mol_type = unassigned RNA
tggatttatcgacaaatgagggc

SEQ ID NO: 1500 - RNA, 23 nt, Homo sapiens
  source 1..23: mol_type = unassigned RNA
ttagagatgattcagaggtcact

SEQ ID NO: 1501 - RNA, 23 nt, Homo sapiens
  source 1..23: mol_type = unassigned RNA
gaagagaaagatgtgttttgttt

SEQ ID NO: 1502 - RNA, 23 nt, Homo sapiens
  source 1..23: mol_type = unassigned RNA
gccaagtgccataaccatgagca

SEQ ID NO: 1503 - RNA, 23 nt, Homo sapiens
  source 1..23: mol_type = unassigned RNA
gccataaccatgagcactactct

SEQ ID NO: 1504 - RNA, 23 nt, Homo sapiens
  source 1..23: mol_type = unassigned RNA
cccatttgcaggatctgtctgtg

SEQ ID NO: 1505 - RNA, 23 nt, Homo sapiens
  source 1..23: mol_type = unassigned RNA
actcatctcagaggaagtcctgg

SEQ ID NO: 1506 - RNA, 23 nt, Homo sapiens
  source 1..23: mol_type = unassigned RNA
accaggagtgtacgggaatgtga

SEQ ID NO: 1507 - RNA, 23 nt, Homo sapiens
  source 1..23: mol_type = unassigned RNA
tgtctggctttggcactctctgc

SEQ ID NO: 1508 - RNA, 23 nt, Homo sapiens
  source 1..23: mol_type = unassigned RNA
tttggcactctctgccattctgt

SEQ ID NO: 1509 - RNA, 23 nt, Homo sapiens
  source 1..23: mol_type = unassigned RNA
ttggcactctctgccattctgtg

SEQ ID NO: 1510 - RNA, 23 nt, Homo sapiens
  source 1..23: mol_type = unassigned RNA
aaaccatggataccaaccggaaa

SEQ ID NO: 1511 - RNA, 23 nt, Homo sapiens
  source 1..23: mol_type = unassigned RNA
aaccatggataccaaccggaaaa

SEQ ID NO: 1512 - RNA, 23 nt, Homo sapiens
  source 1..23: mol_type = unassigned RNA
gggggaaatcaaggatgctcagt

SEQ ID NO: 1513 - RNA, 23 nt, Homo sapiens
  source 1..23: mol_type = unassigned RNA
tgccaagtgccataaccatgagc

SEQ ID NO: 1514 - RNA, 23 nt, Homo sapiens
  source 1..23: mol_type = unassigned RNA
gtcatgcaatcccatttgcagga

SEQ ID NO: 1515 - RNA, 23 nt, Homo sapiens
  source 1..23: mol_type = unassigned RNA
tcccatttgcaggatctgtctgt

SEQ ID NO: 1516 - RNA, 23 nt, Homo sapiens
  source 1..23: mol_type = unassigned RNA
tttgcaggatctgtctgtgcaca

We claim:

1. A double stranded ribonucleic acid (dsRNA) agent, or a salt thereof, for inhibiting expression of transmembrane serine protease 2 (TMPRSS2) in a cell,
wherein the dsRNA agent, or a salt thereof, comprises a sense strand and an antisense strand forming a double stranded region,
wherein the antisense strand comprises at least 15 contiguous nucleotides of the nucleotide sequence 5'-UAGUAAUGAUAGGUAUCUGGAAU-3' of SEQ ID NO: 323; and
wherein the sense strand or the antisense strand is conjugated to one or more lipophilic moieties.

2. The dsRNA agent, or a salt thereof, of claim 1, wherein the antisense strand comprises at least 17 contiguous nucleotides of the nucleotide sequence 5'-UAGUAAUGAUAGGUAUCUGGAAU-3' of SEQ ID NO:323.

3. The dsRNA agent, or a salt thereof, of claim 1, wherein at least one nucleotide comprises a nucleotide modification.

4. The dsRNA agent, or a salt thereof, of claim 3, wherein all of the nucleotides of the sense strand and all of the nucleotides of the antisense strand comprise a nucleotide modification.

5. The dsRNA agent, or a salt thereof, of any claim 3, wherein at least one of the nucleotide modifications is selected from the group a deoxy-nucleotide modification, a 3'-terminal deoxy-thymine (dT) nucleotide modification, a 2'-O-methyl nucleotide modification, a 2'-fluoro nucleotide modification, a 2'-deoxy nucleotide modification, a locked nucleotide modification, an unlocked nucleotide modification, a conformationally restricted nucleotide modification, a constrained ethyl nucleotide modification, an abasic nucleotide modification, a 2'-amino nucleotide modification, a 2'-O-allyl nucleotide modification, 2'-C-alkyl-modified nucleotide modification, a 2'-methoxyethyl nucleotide modification, a 2'-O-alkyl nucleotide modification, a morpholino nucleotide modification, a phosphoramidate modification, a non-natural base comprising nucleotide modification, a tetrahydropyran nucleotide modification, a 1,5-anhydrohexitol nucleotide modification, a cyclohexenyl nucleotide modification, a nucleotide comprising a 5'-phosphorothioate group modification, a nucleotide comprising a 5'-methylphosphonate group modification, a nucleotide comprising a 5' phosphate or 5' phosphate mimic modification, a nucleotide comprising vinyl phosphonate modification, a nucleotide comprising adenosine-glycol nucleic acid (GNA) modification, a nucleotide comprising thymidine-glycol nucleic acid (GNA)S-Isomer modification, a nucleotide comprising 2-hydroxymethyl-tetrahydrofurane-5-phosphate modification, a nucleotide comprising 2'-deoxythymidine-3'phosphate modification, a nucleotide comprising 2'-deoxyguanosine-3'-phosphate modification, a 2'-O hexadecyl nucleotide modification, a nucleotide comprising a 2'-phosphate modification, a cytidine-2-phosphate nucleotide modification, a guanosine-2-phosphate nucleotide modification, a 2'-O-hexadecyl-cytidine-3'-phosphate nucleotide modification, a 2'-O-hexadecyl-adenosine-3'-phosphate nucleotide modification, a 2'-O-hexadecyl-guanosine-3'-phosphate nucleotide modification, a 2'-O-hexadecyl-uridine-3'-phosphate nucleotide modification, a 5'-vinyl phosphonate (VP) modification, a 2-deoxyadenosine-3-phosphate nucleotide modification, a 2'-deoxycytidine-3-phosphate nucleotide modification, a 2-deoxyguanosine-3-phosphate nucleotide modification, a 2-deoxythymidine-3-phosphate nucleotide modification, a 2-deoxyuridine nucleotide modification, and a terminal nucleotide linked to a cholesteryl derivative and a dodecanoic acid bisdecylamide group modification; and combinations thereof.

6. The dsRNA agent, or a salt thereof, of claim 5, further comprising at least one phosphorothioate internucleotide linkage.

7. The dsRNA agent, or a salt thereof, of claim 1, wherein at least one strand comprises a 3' overhang of at least 1 nucleotide.

8. The dsRNA agent, or a salt thereof, of claim 1, wherein each strand is 19-30 nucleotides in length.

9. The dsRNA agent, or a salt thereof, of claim 1, wherein one or more lipophilic moieties are conjugated to one or more internal positions on at least one strand.

10. The dsRNA agent, or a salt thereof, of claim 1, wherein the one or more lipophilic moieties are conjugated to one or more of the internal positions selected from the group consisting of positions 4-8 and 13-18 on the sense strand, and positions 6-10 and 15-18 on the antisense strand, counting from the 5'-end of each strand.

11. The dsRNA agent, or a salt thereof, of claim 1, wherein the lipophilic moiety is an aliphatic, alicyclic, or polyalicyclic compound.

12. The dsRNA agent, or a salt thereof, of claim 11, wherein the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl) lithocholic acid, 03-(oleoyl) cholenic acid, dimethoxytrityl, or phenoxazine.

13. The dsRNA agent, or a salt thereof, of claim 12, wherein the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

14. The dsRNA agent, or a salt thereof, of claim 13, wherein the lipophilic moiety contains a saturated or unsaturated C6-C18 hydrocarbon chain.

15. The dsRNA agent, or a salt thereof, of claim 1, further comprising a phosphate or phosphate mimic at the 5'-end of the antisense strand.

16. The dsRNA agent, or a salt thereof, of claim 1, wherein the base pair at the 1 position of the 5'-end of the antisense strand of the duplex is an AU base pair.

17. An isolated cell containing the dsRNA agent, or a salt thereof, of claim 1.

18. A pharmaceutical composition for inhibiting expression of a TMPRSS2 gene, comprising the dsRNA agent, or a salt thereof, of any one of claim 1.

19. A double stranded ribonucleic acid (dsRNA) agent, or a salt thereof, for inhibiting expression of transmembrane serine protease 2 (TMPRSS2) in a cell,
wherein the dsRNA agent, or a salt thereof, comprises a sense strand and an antisense strand forming a double stranded region,
wherein the sense strand comprises at least 15 contiguous nucleotides of the nucleotide sequence 5'-UCCAGAUACCUAUCAUUACUA-3' of SEQ ID NO:23 and the antisense strand comprises at least 15 contiguous nucleotides of the nucleotide sequence 5'-UAGUAAUGAUAGGUAUCUGGAAU-3' of SEQ ID NO:323; and
wherein the sense strand or the antisense strand is conjugated to one or more lipophilic moieties.

20. The dsRNA agent, or a salt thereof, of claim 1, wherein the antisense strand comprises at least 19 contiguous nucleotides of the nucleotide sequence 5'-UAGUAAUGAUAGGUAUCUGGAAU-3' of SEQ ID NO:323.

21. The dsRNA agent, or a salt thereof, of claim 1, wherein the antisense strand comprises the nucleotide sequence 5'-UAGUAAUGAUAGGUAUCUGGAAU-3' of SEQ ID NO: 323.

22. The dsRNA agent, or a salt thereof, of claim 1, wherein the sense strand comprises the nucleotide sequence 5'-UCCAGAUACCUAUCAUUACUA-3' of SEQ ID NO:23 and the antisense strand comprises the nucleotide sequence 5'-UAGUAAUGAUAGGUAUCUGGAAU-3' of SEQ ID NO:323.

23. The dsRNA agent, or a salt thereof, of claim 1, wherein the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

* * * * *